United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 243

SEQ ID NO: 10040295 - DNA, 22 bp, Homo sapiens
tacagaagcttttgaaaagatg

SEQ ID NO: 10040296 - DNA, 22 bp, Homo sapiens
tacagattttgtgaagaagtgt

SEQ ID NO: 10040297 - DNA, 22 bp, Homo sapiens
taaggcccgtgagtttcatatc

SEQ ID NO: 10040298 - DNA, 22 bp, Homo sapiens
taagggttcagaatgcagtggt

SEQ ID NO: 10040299 - DNA, 22 bp, Homo sapiens
taattagtgtccagcttctgct

SEQ ID NO: 10040300 - DNA, 22 bp, Homo sapiens
gctttggaacttaaatccttgg

SEQ ID NO: 10040301 - DNA, 22 bp, Homo sapiens
ggagcagggcagtgaattctgg

SEQ ID NO: 10040302 - DNA, 22 bp, Homo sapiens
ggagccagagcactggggagcc

SEQ ID NO: 10040303 - DNA, 22 bp, Homo sapiens
ggagcaggctctgtggtttcca

SEQ ID NO: 10040304 - DNA, 22 bp, Homo sapiens
ggagcagggaattacagcgcag

SEQ ID NO: 10040305 - DNA, 22 bp, Homo sapiens
ggacatgattagcagggagagc

SEQ ID NO: 10040306 - DNA, 20 bp, Homo sapiens
gctgtgcctccagctggtgg

SEQ ID NO: 10040307 - DNA, 19 bp, Homo sapiens
gctgtgcccctgccgcttg

SEQ ID NO: 10040308 - DNA, 22 bp, Homo sapiens
gcttgcattctggatctatggt

SEQ ID NO: 10040309 - DNA, 22 bp, Homo sapiens
gcttgctagaagcttaaaggta

SEQ ID NO: 10040310 - DNA, 22 bp, Homo sapiens
gctccctgttctcagccatgat

SEQ ID NO: 10040311 - DNA, 22 bp, Homo sapiens
gctgcctccaatctgtgccccg

SEQ ID NO: 10040312 - DNA, 22 bp, Homo sapiens
gctgcctcactccagcccaata

SEQ ID NO: 10040313 - DNA, 22 bp, Homo sapiens
gctgccctacccgaggcactct

SEQ ID NO: 10040314 - DNA, 18 bp, Homo sapiens
gctcagctatgggaggtt

SEQ ID NO: 10040315 - DNA, 22 bp, Homo sapiens
gctcagctacttacaggtggct

SEQ ID NO: 10040316 - DNA, 21 bp, Homo sapiens
gctccctgctcagctcctggg

SEQ ID NO: 10040317 - DNA, 22 bp, Homo sapiens
gctccctggtattgctgccact

SEQ ID NO: 10040318 - DNA, 22 bp, Homo sapiens
gctccctggtagccatgctctc

SEQ ID NO: 10040319 - DNA, 23 bp, Homo sapiens
gctccctgtccctgcacttaggc

SEQ ID NO: 10040320 - DNA, 22 bp, Homo sapiens
gctccctgactcagttcctgag

SEQ ID NO: 10040321 - DNA, 17 bp, Homo sapiens
gctccctgaggacagct

SEQ ID NO: 10040322 - DNA, 17 bp, Homo sapiens
gctccctgaggacagct

SEQ ID NO: 10040323 - DNA, 22 bp, Homo sapiens
gctccctgcactctgcagccct

SEQ ID NO: 10040324 - DNA, 22 bp, Homo sapiens
gcctttatccctgtacaaggtg

SEQ ID NO: 10040325 - DNA, 22 bp, Homo sapiens
gcctttatcagtttcatggctt

SEQ ID NO: 10040326 - DNA, 22 bp, Homo sapiens
gcctttatatttttctggtgtt

SEQ ID NO: 10040327 - DNA, 22 bp, Homo sapiens
gcctttatattacatttggaag

SEQ ID NO: 10040328 - DNA, 22 bp, Homo sapiens
gcctttatatccctgatatcta

SEQ ID NO: 10040329 - DNA, 17 bp, Homo sapiens
gcctttatacatgctgc

SEQ ID NO: 10040330 - DNA, 22 bp, Homo sapiens
gcctttatcttgggccaagttt

SEQ ID NO: 10040331 - DNA, 22 bp, Homo sapiens
gcctttatcttcctgattcaga

SEQ ID NO: 10040332 - DNA, 22 bp, Homo sapiens
gcctttattgtttattcagtgc

SEQ ID NO: 10040333 - DNA, 23 bp, Homo sapiens
gcctttattaggcacaggggtac

SEQ ID NO: 10040334 - DNA, 22 bp, Homo sapiens
gcctttatgtctgaaaatcagc

SEQ ID NO: 10040335 - DNA, 22 bp, Homo sapiens
gcctttattttcaacggagtgt

SEQ ID NO: 10040336 - DNA, 22 bp, Homo sapiens
gcctttatttacgaaagggaaa

SEQ ID NO: 10040337 - DNA, 22 bp, Homo sapiens
gcagccctggcctggcctactt

SEQ ID NO: 10040338 - DNA, 22 bp, Homo sapiens
gcagccctcgggtactcacgtg

SEQ ID NO: 10040339 - DNA, 22 bp, Homo sapiens
gcaaagatattagaatagagta

SEQ ID NO: 10040340 - DNA, 22 bp, Homo sapiens
gaggcccagagaggttgcatga

SEQ ID NO: 10040341 - DNA, 22 bp, Homo sapiens
gaggcccaaggactctgtcccg

SEQ ID NO: 10040342 - DNA, 22 bp, Homo sapiens
gcacacagtactatatgctaca

SEQ ID NO: 10040343 - DNA, 22 bp, Homo sapiens
gcacagggctgccaggcggctt

SEQ ID NO: 10040344 - DNA, 22 bp, Homo sapiens
gcacaggtcaggagatgagatt

SEQ ID NO: 10040345 - DNA, 22 bp, Homo sapiens
gcagagcaggaaggaagtcagg

SEQ ID NO: 10040346 - DNA, 22 bp, Homo sapiens
gcagagcagaggtgcaggttgg

SEQ ID NO: 10040347 - DNA, 18 bp, Homo sapiens
gcagagcagaagctcaag

SEQ ID NO: 10040348 - DNA, 22 bp, Homo sapiens
gcagagggtcctgtgccagcag

SEQ ID NO: 10040349 - DNA, 22 bp, Homo sapiens
gcagaggtctcttcaaaataat

SEQ ID NO: 10040350 - DNA, 19 bp, Homo sapiens
gcagacaggtccagagagg

SEQ ID NO: 10040351 - DNA, 22 bp, Homo sapiens
gcctcctgggttcatgccattc

SEQ ID NO: 10040352 - DNA, 22 bp, Homo sapiens
gcctcctggggtgccatcatct

SEQ ID NO: 10040353 - DNA, 22 bp, Homo sapiens
gcctcctggattttagtgccat

SEQ ID NO: 10040354 - DNA, 22 bp, Homo sapiens
gcctcctgagaagccacaggct

SEQ ID NO: 10040355 - DNA, 22 bp, Homo sapiens
gcctcccttggtgtctcccggg

SEQ ID NO: 10040356 - DNA, 22 bp, Homo sapiens
gccctggatgtacaggcatgtt

SEQ ID NO: 10040357 - DNA, 22 bp, Homo sapiens
gccctggatggcaggagccatc

SEQ ID NO: 10040358 - DNA, 22 bp, Homo sapiens
gccctggatgctcatggcatca

SEQ ID NO: 10040359 - DNA, 22 bp, Homo sapiens
gccctggagctagactaggaca

SEQ ID NO: 10040360 - DNA, 17 bp, Homo sapiens
gccctggagccaggcta

SEQ ID NO: 10040361 - DNA, 22 bp, Homo sapiens
gccctggagagggatatggcat

SEQ ID NO: 10040362 - DNA, 22 bp, Homo sapiens
gccccaggataaatttgtaaga

SEQ ID NO: 10040363 - DNA, 15 bp, Homo sapiens
gccccaggaatcaaa

SEQ ID NO: 10040364 - DNA, 22 bp, Homo sapiens
gcccagctggcttccagcacat

SEQ ID NO: 10040365 - DNA, 22 bp, Homo sapiens
gccagggttcgaatccgtatgg

SEQ ID NO: 10040366 - DNA, 22 bp, Homo sapiens
gcccagcacagctggaagagtc

SEQ ID NO: 10040367 - DNA, 21 bp, Homo sapiens
gcccagcaaggtgagaaggcc

SEQ ID NO: 10040368 - DNA, 22 bp, Homo sapiens
gccagggtcctgaagaccaagt

SEQ ID NO: 10040369 - DNA, 22 bp, Homo sapiens
gccagggttcaagctattctcc

SEQ ID NO: 10040370 - DNA, 22 bp, Homo sapiens
gcccagcctccaagctccaagg

SEQ ID NO: 10040371 - DNA, 22 bp, Homo sapiens
gcccagccctgaggtcacagct

SEQ ID NO: 10040372 - DNA, 22 bp, Homo sapiens
gccagctcccaagtgagcccct

SEQ ID NO: 10040373 - DNA, 20 bp, Homo sapiens
gccagccctgacacaggagc

SEQ ID NO: 10040374 - DNA, 21 bp, Homo sapiens
gccagcctgtttacctgtggt

SEQ ID NO: 10040375 - DNA, 22 bp, Homo sapiens
gcagtgggagcttaggcagtgc

SEQ ID NO: 10040376 - DNA, 21 bp, Homo sapiens
gcatgcctgcatcttagtgtt

SEQ ID NO: 10040377 - DNA, 22 bp, Homo sapiens
ggcctctggttcgtggtgacct

SEQ ID NO: 10040378 - DNA, 22 bp, Homo sapiens
ggcctcagtttctccatgggtt

SEQ ID NO: 10040379 - DNA, 22 bp, Homo sapiens
ggcctcagtgggccgctgcagg

SEQ ID NO: 10040380 - DNA, 22 bp, Homo sapiens
ggcctcagggttgggcccatta

SEQ ID NO: 10040381 - DNA, 18 bp, Homo sapiens
ggcctcagcctggccgga

SEQ ID NO: 10040382 - DNA, 21 bp, Homo sapiens
ggcctcagccacctggctctg

SEQ ID NO: 10040383 - DNA, 22 bp, Homo sapiens
ggcagtcagtgtggttcataaa

SEQ ID NO: 10040384 - DNA, 22 bp, Homo sapiens
ggcagtcacttttgcttgtgcc

SEQ ID NO: 10040385 - DNA, 22 bp, Homo sapiens
ggcaggtggaagttggcagagc

SEQ ID NO: 10040386 - DNA, 22 bp, Homo sapiens
ggcatggacgtctctgaggcca

SEQ ID NO: 10040387 - DNA, 22 bp, Homo sapiens
ggccaggtggctgtcctggcgt

SEQ ID NO: 10040388 - DNA, 22 bp, Homo sapiens
ggccagtcccctaatccagggc

SEQ ID NO: 10040389 - DNA, 22 bp, Homo sapiens
ggccaaggtgttctgatatgcc

SEQ ID NO: 10040390 - DNA, 23 bp, Homo sapiens
ggagtgcaatggcgccatctcgg

SEQ ID NO: 10040391 - DNA, 22 bp, Homo sapiens
ggagtgagtactggagtagctg

SEQ ID NO: 10040392 - DNA, 22 bp, Homo sapiens
ggagtcaaggaaggctctgtga

SEQ ID NO: 10040393 - DNA, 23 bp, Homo sapiens
ggagccagcctgtggggagcggg

SEQ ID NO: 10040394 - DNA, 22 bp, Homo sapiens
ggagccagaggctgctgctgtg

SEQ ID NO: 10040395 - DNA, 22 bp, Homo sapiens
ggagtgaggcatttgtagctga

SEQ ID NO: 10040396 - DNA, 22 bp, Homo sapiens
ggagtccatgcagcttgagaca

SEQ ID NO: 10040397 - DNA, 22 bp, Homo sapiens
ggagtcacctgggaggactggg

SEQ ID NO: 10040398 - DNA, 20 bp, Homo sapiens
ggagtcaccaagagagaccc

SEQ ID NO: 10040399 - DNA, 22 bp, Homo sapiens
ggagtcacctgggaggactggg

SEQ ID NO: 10040400 - DNA, 22 bp, Homo sapiens
ggagtcaggagcaggctgggct

SEQ ID NO: 10040401 - DNA, 22 bp, Homo sapiens
ggcaggaggtgagtggcgggtg

SEQ ID NO: 10040402 - DNA, 22 bp, Homo sapiens
ggcaggagggcggacaatgacc

SEQ ID NO: 10040403 - DNA, 22 bp, Homo sapiens
ggcacagcgactaccatcgaaa

SEQ ID NO: 10040404 - DNA, 22 bp, Homo sapiens
ggcacagctcaggtcccagctc

SEQ ID NO: 10040405 - DNA, 22 bp, Homo sapiens
ggcacagctgatgcagacacac

SEQ ID NO: 10040406 - DNA, 18 bp, Homo sapiens
ggctccaggacctaccca

SEQ ID NO: 10040407 - DNA, 22 bp, Homo sapiens
ggctccagatgtctcctggcaa

SEQ ID NO: 10040408 - DNA, 22 bp, Homo sapiens
ggctccaggagggccttggcca

SEQ ID NO: 10040409 - DNA, 22 bp, Homo sapiens
ggctccagatgtcccctggcaa

SEQ ID NO: 10040410 - DNA, 22 bp, Homo sapiens
ggcttctctgtctagtttctac

SEQ ID NO: 10040411 - DNA, 22 bp, Homo sapiens
ggcttctcctggaagtacagag

SEQ ID NO: 10040412 - DNA, 22 bp, Homo sapiens
gggagacacgctgcaggcataa

SEQ ID NO: 10040413 - DNA, 20 bp, Homo sapiens
gggagacagggccagtgtcc

SEQ ID NO: 10040414 - DNA, 22 bp, Homo sapiens
gggagagagaaaacgtggcgca

SEQ ID NO: 10040415 - DNA, 22 bp, Homo sapiens
gggagaggttacccgagcaact

SEQ ID NO: 10040416 - DNA, 18 bp, Homo sapiens
gggagctgggaagctggt

SEQ ID NO: 10040417 - DNA, 22 bp, Homo sapiens
gggcagctctggctgtgggaag

SEQ ID NO: 10040418 - DNA, 22 bp, Homo sapiens
gggcaggaacaaatcaaatgat

SEQ ID NO: 10040419 - DNA, 22 bp, Homo sapiens
gggcagctgcccctctctgggc

SEQ ID NO: 10040420 - DNA, 22 bp, Homo sapiens
gggcagctgccagaggccatgg

SEQ ID NO: 10040421 - DNA, 22 bp, Homo sapiens
gggcaggagagggccacctgga

SEQ ID NO: 10040422 - DNA, 22 bp, Homo sapiens
gggcaggaggctaattctgcat

SEQ ID NO: 10040423 - DNA, 22 bp, Homo sapiens
gggcaggagagaacagtcatgg

SEQ ID NO: 10040424 - DNA, 22 bp, Homo sapiens
gggcaggagaaggtggatgtcc

SEQ ID NO: 10040425 - DNA, 16 bp, Homo sapiens
gggcaggaatcagggt

SEQ ID NO: 10040426 - DNA, 22 bp, Homo sapiens
gggcaggctgagcatgtcacct

SEQ ID NO: 10040427 - DNA, 22 bp, Homo sapiens
gggcaggatgcagtttcagaga

SEQ ID NO: 10040428 - DNA, 22 bp, Homo sapiens
gtgaagcagttgcgtgggttcc

SEQ ID NO: 10040429 - DNA, 22 bp, Homo sapiens
gtgaagcatatgcttctctgcc

SEQ ID NO: 10040430 - DNA, 22 bp, Homo sapiens
gtgaagcataactgaaggattt

SEQ ID NO: 10040431 - DNA, 22 bp, Homo sapiens
gtgaagcacatgggcgttgggt

SEQ ID NO: 10040432 - DNA, 22 bp, Homo sapiens
gtgaagcagggaaggaaaggat

SEQ ID NO: 10040433 - DNA, 22 bp, Homo sapiens
gtgaagcagagtgtggaagcaa

SEQ ID NO: 10040434 - DNA, 22 bp, Homo sapiens
gtgaagcacgctgccgcactgg

SEQ ID NO: 10040435 - DNA, 22 bp, Homo sapiens
gtctgctcatgctaccgcgggc

SEQ ID NO: 10040436 - DNA, 20 bp, Homo sapiens
gtgcagaggcagcctgtggg

SEQ ID NO: 10040437 - DNA, 22 bp, Homo sapiens
gtgcagaggacgtggcggcctc

SEQ ID NO: 10040438 - DNA, 22 bp, Homo sapiens
gtgcataatttggcaatagaat

SEQ ID NO: 10040439 - DNA, 22 bp, Homo sapiens
gtgcactgtctggtcaagagca

SEQ ID NO: 10040440 - DNA, 22 bp, Homo sapiens
gtgcagaagtaacaattaaaga

SEQ ID NO: 10040441 - DNA, 22 bp, Homo sapiens
gtgcagaagtaacaattaaaga

SEQ ID NO: 10040442 - DNA, 22 bp, Homo sapiens
gtgcagagaggaccttggggag

SEQ ID NO: 10040443 - DNA, 17 bp, Homo sapiens
gtcctgggaggagagag

SEQ ID NO: 10040444 - DNA, 22 bp, Homo sapiens
gtccctgcatctgcaggccatg

SEQ ID NO: 10040445 - DNA, 22 bp, Homo sapiens
ggtttcacaatttagagcagtg

SEQ ID NO: 10040446 - DNA, 22 bp, Homo sapiens
ggtttcactagaagaaggaatt

SEQ ID NO: 10040447 - DNA, 22 bp, Homo sapiens
ggtagtcatggatagctatgag

SEQ ID NO: 10040448 - DNA, 22 bp, Homo sapiens
ggtagtcagtgttagtttgatt

SEQ ID NO: 10040449 - DNA, 22 bp, Homo sapiens
ggtcagagggtgggctgcctgt

SEQ ID NO: 10040450 - DNA, 22 bp, Homo sapiens
ggtcagagggtgggctgcctgt

SEQ ID NO: 10040451 - DNA, 22 bp, Homo sapiens
ggtcagaggggattccttggga

SEQ ID NO: 10040452 - DNA, 22 bp, Homo sapiens
ggtcagagccgttagcattcag

SEQ ID NO: 10040453 - DNA, 22 bp, Homo sapiens
gggctgagagctggaatctgag

SEQ ID NO: 10040454 - DNA, 22 bp, Homo sapiens
gggcatgtaggaatccatggag

SEQ ID NO: 10040455 - DNA, 22 bp, Homo sapiens
ctgggaggcccacgttgggaag

SEQ ID NO: 10040456 - DNA, 22 bp, Homo sapiens
ctgggtaaaggctgcttttcta

SEQ ID NO: 10040457 - DNA, 22 bp, Homo sapiens
ctggccctcagactcatgggca

SEQ ID NO: 10040458 - DNA, 22 bp, Homo sapiens
ctggccctggagggctgtgcga

SEQ ID NO: 10040459 - DNA, 22 bp, Homo sapiens
ctggcccagtctcagagtgtca

SEQ ID NO: 10040460 - DNA, 22 bp, Homo sapiens
ctggcccaggtggtcgttgagg

SEQ ID NO: 10040461 - DNA, 19 bp, Homo sapiens
ctggccaggccaggggccc

SEQ ID NO: 10040462 - DNA, 22 bp, Homo sapiens
ctggccagcctcccaggtaccc

SEQ ID NO: 10040463 - DNA, 22 bp, Homo sapiens
ctggccagctgacagcagggct

SEQ ID NO: 10040464 - DNA, 22 bp, Homo sapiens
ctgtgccattctttgtagcatg

SEQ ID NO: 10040465 - DNA, 22 bp, Homo sapiens
ctgtgccagcctgtcccaggag

SEQ ID NO: 10040466 - DNA, 22 bp, Homo sapiens
ctgtgccactgccccaggcctc

SEQ ID NO: 10040467 - DNA, 22 bp, Homo sapiens
cttcctggatgagcaggctgat

SEQ ID NO: 10040468 - DNA, 22 bp, Homo sapiens
cttcctgggcaatgttctgctt

SEQ ID NO: 10040469 - DNA, 22 bp, Homo sapiens
cttgcctacttgtcaaccagca

SEQ ID NO: 10040470 - DNA, 22 bp, Homo sapiens
cttgtagaattgaaatggtctc

SEQ ID NO: 10040471 - DNA, 22 bp, Homo sapiens
gagcagcaagcactcaaaggct

SEQ ID NO: 10040472 - DNA, 22 bp, Homo sapiens
gagcagcaggtggggctggctt

SEQ ID NO: 10040473 - DNA, 22 bp, Homo sapiens
gagcagcagttgttacaatgat

SEQ ID NO: 10040474 - DNA, 20 bp, Homo sapiens
gagatggacagatgaagggg

SEQ ID NO: 10040475 - DNA, 22 bp, Homo sapiens
gagatggagaaggaagctgttt

SEQ ID NO: 10040476 - DNA, 22 bp, Homo sapiens
gagaagggatatggcttcttga

SEQ ID NO: 10040477 - DNA, 22 bp, Homo sapiens
gagaagggatatgccactctcg

SEQ ID NO: 10040478 - DNA, 22 bp, Homo sapiens
gagagggatactgagttttggt

SEQ ID NO: 10040479 - DNA, 22 bp, Homo sapiens
gagagggagccagccaggaacc

SEQ ID NO: 10040480 - DNA, 22 bp, Homo sapiens
gagcctggattgaagtgggtgg

SEQ ID NO: 10040481 - DNA, 22 bp, Homo sapiens
gaggaggcacttgagcagatgt

SEQ ID NO: 10040482 - DNA, 22 bp, Homo sapiens
gaggaggcactagttagtgaca

SEQ ID NO: 10040483 - DNA, 22 bp, Homo sapiens
gaggaggccagtggaaggaagc

SEQ ID NO: 10040484 - DNA, 22 bp, Homo sapiens
gaggaggctaagtgggctctgg

SEQ ID NO: 10040485 - DNA, 22 bp, Homo sapiens
gaggcacatcacttggtgcatt

SEQ ID NO: 10040486 - DNA, 22 bp, Homo sapiens
ctttcagttacagttacacaca

SEQ ID NO: 10040487 - DNA, 22 bp, Homo sapiens
gaagagctgtgattcaggctta

SEQ ID NO: 10040488 - DNA, 22 bp, Homo sapiens
gaagatttgcccatgcactttt

SEQ ID NO: 10040489 - DNA, 22 bp, Homo sapiens
gacaagctcttgtttcatggtt

SEQ ID NO: 10040490 - DNA, 22 bp, Homo sapiens
gaaggaaaacagatctgcctga

SEQ ID NO: 10040491 - DNA, 22 bp, Homo sapiens
gaagctttgtcttgtctcctgg

SEQ ID NO: 10040492 - DNA, 22 bp, Homo sapiens
gaagcttcgaaagagtgatttc

SEQ ID NO: 10040493 - DNA, 22 bp, Homo sapiens
gaagttttctgaggctgtagct

SEQ ID NO: 10040494 - DNA, 22 bp, Homo sapiens
ctgacaggttggtagctttgga

SEQ ID NO: 10040495 - DNA, 22 bp, Homo sapiens
ctctttgaaatccatcactgct

SEQ ID NO: 10040496 - DNA, 22 bp, Homo sapiens
ctctttggagaagcacgtatta

SEQ ID NO: 10040497 - DNA, 22 bp, Homo sapiens
ctctttggatagaattacaaag

SEQ ID NO: 10040498 - DNA, 19 bp, Homo sapiens
ctctttggagatccttgga

SEQ ID NO: 10040499 - DNA, 22 bp, Homo sapiens
ctctttggatgtttatgataag

SEQ ID NO: 10040500 - DNA, 22 bp, Homo sapiens
ctgcacaggggatgagggcagt

SEQ ID NO: 10040501 - DNA, 22 bp, Homo sapiens
ctgcacagctgggcaagatata

SEQ ID NO: 10040502 - DNA, 22 bp, Homo sapiens
ctgcacagctggccagggagag

SEQ ID NO: 10040503 - DNA, 22 bp, Homo sapiens
ctgcacacatcgcactgcccgt

SEQ ID NO: 10040504 - DNA, 22 bp, Homo sapiens
ctgcacacatatggcttctctc

SEQ ID NO: 10040505 - DNA, 22 bp, Homo sapiens
ctgcacatagtaagtactcaat

SEQ ID NO: 10040506 - DNA, 22 bp, Homo sapiens
ctgcaccacagcctgaggcagc

SEQ ID NO: 10040507 - DNA, 22 bp, Homo sapiens
ctgcactgacttccccggctgc

SEQ ID NO: 10040508 - DNA, 22 bp, Homo sapiens
ctgcactgagaccctctttgct

SEQ ID NO: 10040509 - DNA, 19 bp, Homo sapiens
ctgcactgagaaaaggagg

SEQ ID NO: 10040510 - DNA, 22 bp, Homo sapiens
ctgcactgagcatctaacctta

SEQ ID NO: 10040511 - DNA, 22 bp, Homo sapiens
ctgcactgctgatcccaggtct

SEQ ID NO: 10040512 - DNA, 22 bp, Homo sapiens
ctgcactgagctctcccagccc

SEQ ID NO: 10040513 - DNA, 18 bp, Homo sapiens
ctgcactgtgggtagctc

SEQ ID NO: 10040514 - DNA, 22 bp, Homo sapiens
ctgcactgtgtaacagataact

SEQ ID NO: 10040515 - DNA, 22 bp, Homo sapiens
ctgcactgtgtattccttggct

SEQ ID NO: 10040516 - DNA, 22 bp, Homo sapiens
tttgctaagagaactcgtggac

SEQ ID NO: 10040517 - DNA, 22 bp, Homo sapiens
tttgctaaaatgtattgggatt

SEQ ID NO: 10040518 - DNA, 22 bp, Homo sapiens
tttgctaaaagtgatgaagaca

SEQ ID NO: 10040519 - DNA, 22 bp, Homo sapiens
tttgctaaaaggccattgattt

SEQ ID NO: 10040520 - DNA, 22 bp, Homo sapiens
tttgcctgggaattctagtgta

SEQ ID NO: 10040521 - DNA, 22 bp, Homo sapiens
ctctgccatcttggagctcaag

SEQ ID NO: 10040522 - DNA, 22 bp, Homo sapiens
tttccttgttattatttgtcct

SEQ ID NO: 10040523 - DNA, 22 bp, Homo sapiens
tttccttgttcatttgccctat

SEQ ID NO: 10040524 - DNA, 22 bp, Homo sapiens
tttcctttatgacatcaccact

SEQ ID NO: 10040525 - DNA, 22 bp, Homo sapiens
ttggtcagctaataaggacagg

SEQ ID NO: 10040526 - DNA, 22 bp, Homo sapiens
ctccattgttcgcgcagctgca

SEQ ID NO: 10040527 - DNA, 22 bp, Homo sapiens
ctcccaggcagggctgcccact

SEQ ID NO: 10040528 - DNA, 22 bp, Homo sapiens
ctccagccagagtgcctctgtt

SEQ ID NO: 10040529 - DNA, 20 bp, Homo sapiens
ctccagcccctgccctggtc

SEQ ID NO: 10040530 - DNA, 22 bp, Homo sapiens
tttatttaaagtcgtgtgttaa

SEQ ID NO: 10040531 - DNA, 22 bp, Homo sapiens
tttatttaccttatgtcctcca

SEQ ID NO: 10040532 - DNA, 16 bp, Homo sapiens
tttatttactagtgtt

SEQ ID NO: 10040533 - DNA, 18 bp, Homo sapiens
tttccttgtatgaacata

SEQ ID NO: 10040534 - DNA, 22 bp, Homo sapiens
tttccttgggtctcttagtggc

SEQ ID NO: 10040535 - DNA, 22 bp, Homo sapiens
tttccttgcctcctgtccttct

SEQ ID NO: 10040536 - DNA, 22 bp, Homo sapiens
cgcccagggcaggaggccgctc

SEQ ID NO: 10040537 - DNA, 22 bp, Homo sapiens
cgcccagctgaaatctccaggc

SEQ ID NO: 10040538 - DNA, 20 bp, Homo sapiens
cgcccaggagggcccatgtg

SEQ ID NO: 10040539 - DNA, 22 bp, Homo sapiens
cgccccagtctgtaggtgcccc

SEQ ID NO: 10040540 - DNA, 23 bp, Homo sapiens
cgcccagcctcagtgacctgggc

SEQ ID NO: 10040541 - DNA, 22 bp, Homo sapiens
ttcaggcccaacgcacagcttc

SEQ ID NO: 10040542 - DNA, 22 bp, Homo sapiens
ttcaggcccagcacagcgcgtg

SEQ ID NO: 10040543 - DNA, 22 bp, Homo sapiens
ttcaggcctaatttctagcccc

SEQ ID NO: 10040544 - DNA, 22 bp, Homo sapiens
ttcaggcctctaaagggaaagc

SEQ ID NO: 10040545 - DNA, 22 bp, Homo sapiens
ttcagaggacaaccagccatct

SEQ ID NO: 10040546 - DNA, 22 bp, Homo sapiens
ctcaaaagacttaaacataaga

SEQ ID NO: 10040547 - DNA, 22 bp, Homo sapiens
ctcacaccagcttacaagactt

SEQ ID NO: 10040548 - DNA, 22 bp, Homo sapiens
ctatgtatgcgattagaatttt

SEQ ID NO: 10040549 - DNA, 22 bp, Homo sapiens
ctacagcagagctacactaact

SEQ ID NO: 10040550 - DNA, 22 bp, Homo sapiens
ctacagcagagaccagccacat

SEQ ID NO: 10040551 - DNA, 22 bp, Homo sapiens
ctagaaaaatactttattgtga

SEQ ID NO: 10040552 - DNA, 22 bp, Homo sapiens
ctactggccatctgatctacaa

SEQ ID NO: 10040553 - DNA, 23 bp, Homo sapiens
tgttccagatacgccttttcctc

SEQ ID NO: 10040554 - DNA, 22 bp, Homo sapiens
cctgggcaacatagtgagacct

SEQ ID NO: 10040555 - DNA, 22 bp, Homo sapiens
cctgggcaacatagtgagaccc

SEQ ID NO: 10040556 - DNA, 22 bp, Homo sapiens
cctgggcaatatagtgaggccc

SEQ ID NO: 10040557 - DNA, 22 bp, Homo sapiens
tggggcttctcctgtaggctca

SEQ ID NO: 10040558 - DNA, 23 bp, Homo sapiens
cctgtctgtgctgggtggacaca

SEQ ID NO: 10040559 - DNA, 22 bp, Homo sapiens
cctgtgctgggtgtgagggaca

SEQ ID NO: 10040560 - DNA, 22 bp, Homo sapiens
ttaaagtttcagaaacttggtc

SEQ ID NO: 10040561 - DNA, 22 bp, Homo sapiens
cctgtgtcttccccactggtgt

SEQ ID NO: 10040562 - DNA, 19 bp, Homo sapiens
ccttccccttcagcctctg

SEQ ID NO: 10040563 - DNA, 20 bp, Homo sapiens
ccttccccacccgctgaggt

SEQ ID NO: 10040564 - DNA, 22 bp, Homo sapiens
ccttccccaggtgctcactgtc

SEQ ID NO: 10040565 - DNA, 22 bp, Homo sapiens
ccttccttgtctacaaaagctc

SEQ ID NO: 10040566 - DNA, 22 bp, Homo sapiens
ttacttttgcaccaaactaata

SEQ ID NO: 10040567 - DNA, 22 bp, Homo sapiens
cctgagcctgagtggtgcaggg

SEQ ID NO: 10040568 - DNA, 22 bp, Homo sapiens
tgggcccaagagagtctccaac

SEQ ID NO: 10040569 - DNA, 22 bp, Homo sapiens
tgggccagtttctcattgaaat

SEQ ID NO: 10040570 - DNA, 22 bp, Homo sapiens
cctcttctaggacgtccttgtg

SEQ ID NO: 10040571 - DNA, 22 bp, Homo sapiens
tgggcccatcattgctgtgggc

SEQ ID NO: 10040572 - DNA, 22 bp, Homo sapiens
cctctgcgcccttgatcagcca

SEQ ID NO: 10040573 - DNA, 22 bp, Homo sapiens
tggcccagagcactgctgggca

SEQ ID NO: 10040574 - DNA, 20 bp, Homo sapiens
tggcccagcacgacgaggac

SEQ ID NO: 10040575 - DNA, 22 bp, Homo sapiens
tggcccagcactccaagtaggg

SEQ ID NO: 10040576 - DNA, 19 bp, Homo sapiens
tggcccagatggtcctggg

SEQ ID NO: 10040577 - DNA, 22 bp, Homo sapiens
tggcccagatctctgaccttga

SEQ ID NO: 10040578 - DNA, 21 bp, Homo sapiens
cctagcctcttacccagcttt

SEQ ID NO: 10040579 - DNA, 22 bp, Homo sapiens
cccttcccttctgggagatcca

SEQ ID NO: 10040580 - DNA, 21 bp, Homo sapiens
tgctggccatgtgctgggcat

SEQ ID NO: 10040581 - DNA, 22 bp, Homo sapiens
tgctggcctcggcgctgggcct

SEQ ID NO: 10040582 - DNA, 22 bp, Homo sapiens
cccattcatcctcgcttccttc

SEQ ID NO: 10040583 - DNA, 20 bp, Homo sapiens
ccctgagaccagagagcagc

SEQ ID NO: 10040584 - DNA, 20 bp, Homo sapiens
ccctgagacgactgagctcc

SEQ ID NO: 10040585 - DNA, 20 bp, Homo sapiens
ccctgagacaaaggaggggc

SEQ ID NO: 10040586 - DNA, 22 bp, Homo sapiens
ccctctcctggctgcatggagc

SEQ ID NO: 10040587 - DNA, 22 bp, Homo sapiens
ccctctccctgcagaatgtggc

SEQ ID NO: 10040588 - DNA, 19 bp, Homo sapiens
cccagggtttcctctctcc

SEQ ID NO: 10040589 - DNA, 22 bp, Homo sapiens
cccagggtggatgcaagcagca

SEQ ID NO: 10040590 - DNA, 22 bp, Homo sapiens
cccagggttgcctgcctctgct

SEQ ID NO: 10040591 - DNA, 22 bp, Homo sapiens
cccagggtccggataaccctgg

SEQ ID NO: 10040592 - DNA, 22 bp, Homo sapiens
cccagggtccctgctctctgtg

SEQ ID NO: 10040593 - DNA, 22 bp, Homo sapiens
cccagggtgcggccctggctgg

SEQ ID NO: 10040594 - DNA, 22 bp, Homo sapiens
cccagggtgctaattaaatatg

SEQ ID NO: 10040595 - DNA, 22 bp, Homo sapiens
cccagggtagctgagctggcag

SEQ ID NO: 10040596 - DNA, 22 bp, Homo sapiens
cccagggtaatcatgtgaagcc

SEQ ID NO: 10040597 - DNA, 22 bp, Homo sapiens
tgccttcctaatggtggggttt

SEQ ID NO: 10040598 - DNA, 22 bp, Homo sapiens
tgccctggtgaagtgctctcct

SEQ ID NO: 10040599 - DNA, 22 bp, Homo sapiens
tgcccagctattcctttcttag

SEQ ID NO: 10040600 - DNA, 22 bp, Homo sapiens
tgcccagcgcccacattctgtc

SEQ ID NO: 10040601 - DNA, 22 bp, Homo sapiens
tgcccagcctaaacttggcaag

SEQ ID NO: 10040602 - DNA, 22 bp, Homo sapiens
tgcccagcccctatccctggga

SEQ ID NO: 10040603 - DNA, 22 bp, Homo sapiens
tgcccagctgtcaaagtagata

SEQ ID NO: 10040604 - DNA, 22 bp, Homo sapiens
tgcccagccaatttgttatgtt

SEQ ID NO: 10040605 - DNA, 22 bp, Homo sapiens
tgccatattgcaaagtgtctgc

SEQ ID NO: 10040606 - DNA, 22 bp, Homo sapiens
tgccatattattgagcatatta

SEQ ID NO: 10040607 - DNA, 22 bp, Homo sapiens
tgccatagcaatggtaagctga

SEQ ID NO: 10040608 - DNA, 22 bp, Homo sapiens
tgcccagccagtttatggtaat

SEQ ID NO: 10040609 - DNA, 22 bp, Homo sapiens
tgccctggggagcccagccagg

SEQ ID NO: 10040610 - DNA, 22 bp, Homo sapiens
tgccctgggctttgctatgact

SEQ ID NO: 10040611 - DNA, 22 bp, Homo sapiens
cccaggagagaggccagttggc

SEQ ID NO: 10040612 - DNA, 22 bp, Homo sapiens
ccaggggctgcagatccatggt

SEQ ID NO: 10040613 - DNA, 22 bp, Homo sapiens
ccagggtcacaaataactgcag

SEQ ID NO: 10040614 - DNA, 22 bp, Homo sapiens
tgcacacatgtttacaagcatc

SEQ ID NO: 10040615 - DNA, 22 bp, Homo sapiens
tgcacacctctccaccactctc

SEQ ID NO: 10040616 - DNA, 22 bp, Homo sapiens
tgcacacatatgagcatgtgtg

SEQ ID NO: 10040617 - DNA, 22 bp, Homo sapiens
tgaggtagggaaggctggtatt

SEQ ID NO: 10040618 - DNA, 22 bp, Homo sapiens
tgaggtagtttgttgtacagta

SEQ ID NO: 10040619 - DNA, 21 bp, Homo sapiens
tgaggtagtgtttgtcaagtt

SEQ ID NO: 10040620 - DNA, 22 bp, Homo sapiens
tgaggtagtaaaggtgttagtt

SEQ ID NO: 10040621 - DNA, 22 bp, Homo sapiens
tgaggtagtgcttgtcatgttt

SEQ ID NO: 10040622 - DNA, 22 bp, Homo sapiens
ccatgtggggtcagtgtttggg

SEQ ID NO: 10040623 - DNA, 22 bp, Homo sapiens
ccatgtggctagcgtgcctgca

SEQ ID NO: 10040624 - DNA, 22 bp, Homo sapiens
tctgctattttctatctgtgtg

SEQ ID NO: 10040625 - DNA, 22 bp, Homo sapiens
tctcagactatagtagagattc

SEQ ID NO: 10040626 - DNA, 22 bp, Homo sapiens
tctgctttcttgcgcagatgtg

SEQ ID NO: 10040627 - DNA, 22 bp, Homo sapiens
ccaggcaggcgatggtgcagtg

SEQ ID NO: 10040628 - DNA, 22 bp, Homo sapiens
tctttgggagaaggggtcccag

SEQ ID NO: 10040629 - DNA, 22 bp, Homo sapiens
tctttggctttgccacacccaa

SEQ ID NO: 10040630 - DNA, 22 bp, Homo sapiens
tctttggcttgtctcctcagtt

SEQ ID NO: 10040631 - DNA, 22 bp, Homo sapiens
tctttggcatttaggagcagga

SEQ ID NO: 10040632 - DNA, 22 bp, Homo sapiens
tctttggccttaggagcccttg

SEQ ID NO: 10040633 - DNA, 22 bp, Homo sapiens
ccaggctctgcgctggacatgg

SEQ ID NO: 10040634 - DNA, 22 bp, Homo sapiens
tctttcttattatgctcaatgt

SEQ ID NO: 10040635 - DNA, 22 bp, Homo sapiens
catgacagatgcaaaggattgg

SEQ ID NO: 10040636 - DNA, 22 bp, Homo sapiens
catgcaggtctggagcttgggg

SEQ ID NO: 10040637 - DNA, 22 bp, Homo sapiens
catgcaggttatatgtgcttct

SEQ ID NO: 10040638 - DNA, 22 bp, Homo sapiens
catggccacatctagctgcaag

SEQ ID NO: 10040639 - DNA, 19 bp, Homo sapiens
catctggatgattctcctg

SEQ ID NO: 10040640 - DNA, 22 bp, Homo sapiens
catctgcaggggaagccagttt

SEQ ID NO: 10040641 - DNA, 22 bp, Homo sapiens
tcagtcaggttctgatttctgg

SEQ ID NO: 10040642 - DNA, 22 bp, Homo sapiens
tcagtcagaatcaccagacttt

SEQ ID NO: 10040643 - DNA, 22 bp, Homo sapiens
tcaggcctccaggttaccattt

SEQ ID NO: 10040644 - DNA, 22 bp, Homo sapiens
catagaaagtattatggaattt

SEQ ID NO: 10040645 - DNA, 22 bp, Homo sapiens
catagaaatcaggtgagaatct

SEQ ID NO: 10040646 - DNA, 22 bp, Homo sapiens
cagttgaatggtcagacaaggc

SEQ ID NO: 10040647 - DNA, 23 bp, Homo sapiens
cataaaatattagtatggtagca

SEQ ID NO: 10040648 - DNA, 22 bp, Homo sapiens
catgggaggcctgctgctggtg

SEQ ID NO: 10040649 - DNA, 22 bp, Homo sapiens
catgggaggttggcttggcatg

SEQ ID NO: 10040650 - DNA, 22 bp, Homo sapiens
catgggaggtctgcaaggtgct

SEQ ID NO: 10040651 - DNA, 22 bp, Homo sapiens
cattcttgaaccaggcactgtg

SEQ ID NO: 10040652 - DNA, 22 bp, Homo sapiens
tccctgctttcttgtgagggga

SEQ ID NO: 10040653 - DNA, 22 bp, Homo sapiens
tcctgggagacccagctgtgga

SEQ ID NO: 10040654 - DNA, 19 bp, Homo sapiens
tccttccccccagcacaga

SEQ ID NO: 10040655 - DNA, 22 bp, Homo sapiens
ccagacaggggctgttcctgct

SEQ ID NO: 10040656 - DNA, 22 bp, Homo sapiens
ccactgggggctgctcccaggt

SEQ ID NO: 10040657 - DNA, 22 bp, Homo sapiens
tcaagcagggtagcaagctggt

SEQ ID NO: 10040658 - DNA, 22 bp, Homo sapiens
cagtcagggacaccagctagga

SEQ ID NO: 10040659 - DNA, 22 bp, Homo sapiens
cagtcaggaatgcctccttcct

SEQ ID NO: 10040660 - DNA, 22 bp, Homo sapiens
cagtcaggctgcgcttctctga

SEQ ID NO: 10040661 - DNA, 22 bp, Homo sapiens
caggtagctgcagagactattt

SEQ ID NO: 10040662 - DNA, 22 bp, Homo sapiens
caggtagcttttgatattaggg

SEQ ID NO: 10040663 - DNA, 22 bp, Homo sapiens
caggtagctgctggccatgtac

SEQ ID NO: 10040664 - DNA, 22 bp, Homo sapiens
cagggagcagcgctggggcctc

SEQ ID NO: 10040665 - DNA, 23 bp, Homo sapiens
tagattgctacaagtcattgaat

SEQ ID NO: 10040666 - DNA, 22 bp, Homo sapiens
cagggccattggaacaaagagg

SEQ ID NO: 10040667 - DNA, 20 bp, Homo sapiens
cagggcctaagagctgaaaa

SEQ ID NO: 10040668 - DNA, 22 bp, Homo sapiens
cagggggctcaaaggagagtgc

SEQ ID NO: 10040669 - DNA, 22 bp, Homo sapiens
cagggtccccgggtctcctgtg

SEQ ID NO: 10040670 - DNA, 22 bp, Homo sapiens
cagggtccggctgcctggctgt

SEQ ID NO: 10040671 - DNA, 22 bp, Homo sapiens
cagggtggggaaatagcgccct

SEQ ID NO: 10040672 - DNA, 22 bp, Homo sapiens
cagctcacccatcacgtctgct

SEQ ID NO: 10040673 - DNA, 22 bp, Homo sapiens
caggcagcagaggagtgtggga

SEQ ID NO: 10040674 - DNA, 22 bp, Homo sapiens
taatacaaggcaggaagcagta

SEQ ID NO: 10040675 - DNA, 22 bp, Homo sapiens
tacaaaaaattgatactgacga

SEQ ID NO: 10040676 - DNA, 22 bp, Homo sapiens
caggcccacgaggcacacagag

SEQ ID NO: 10040677 - DNA, 22 bp, Homo sapiens
caggcccactgcttgtctagtc

SEQ ID NO: 10040678 - DNA, 22 bp, Homo sapiens
cagggacagagactgcaccttg

SEQ ID NO: 10040679 - DNA, 22 bp, Homo sapiens
caggctttactttctctctgaa

SEQ ID NO: 10040680 - DNA, 22 bp, Homo sapiens
tagaaacaaaatctgatgactc

SEQ ID NO: 10040681 - DNA, 22 bp, Homo sapiens
tagaaaagtatgggactgacat

SEQ ID NO: 10040682 - DNA, 22 bp, Homo sapiens
caggccttttttcctgcagtgt

SEQ ID NO: 10040683 - DNA, 22 bp, Homo sapiens
caggcctttctggggaagtgag

SEQ ID NO: 10040684 - DNA, 22 bp, Homo sapiens
caggcctttcttggggcttaga

SEQ ID NO: 10040685 - DNA, 22 bp, Homo sapiens
tacatttcagagctcctctctg

SEQ ID NO: 10040686 - DNA, 22 bp, Homo sapiens
caggctacatttgctctgagaa

SEQ ID NO: 10040687 - DNA, 22 bp, Homo sapiens
caggcccagcccttagccaggt

SEQ ID NO: 10040688 - DNA, 22 bp, Homo sapiens
ttaaattaggactctagttctg

SEQ ID NO: 10040689 - DNA, 20 bp, Homo sapiens
ttaagaaaagcacatcctgc

SEQ ID NO: 10040690 - DNA, 22 bp, Homo sapiens
tgtgtgaactctctgatgtaca

SEQ ID NO: 10040691 - DNA, 22 bp, Homo sapiens
tccccagggtccctgcttccat

SEQ ID NO: 10040692 - DNA, 22 bp, Homo sapiens
tccccaggtcctgtcggctcct

SEQ ID NO: 10040693 - DNA, 22 bp, Homo sapiens
tgtggcagaactgggactcaaa

SEQ ID NO: 10040694 - DNA, 22 bp, Homo sapiens
tgtggcagagtaaggacccagt

SEQ ID NO: 10040695 - DNA, 22 bp, Homo sapiens
tgtggagtggtctgaaggctcc

SEQ ID NO: 10040696 - DNA, 22 bp, Homo sapiens
tgttcctggaaagccaggtggg

SEQ ID NO: 10040697 - DNA, 22 bp, Homo sapiens
tgttcctggttcctgcatgatg

SEQ ID NO: 10040698 - DNA, 22 bp, Homo sapiens
tgttcctgtactgctgtggctt

SEQ ID NO: 10040699 - DNA, 22 bp, Homo sapiens
tgttcctgaatgcctggctggc

SEQ ID NO: 10040700 - DNA, 22 bp, Homo sapiens
tgttcctgacggccaaagaggt

SEQ ID NO: 10040701 - DNA, 21 bp, Homo sapiens
tgttcctgttctctaggatcc

SEQ ID NO: 10040702 - DNA, 17 bp, Homo sapiens
tgtttcacttggggaaa

SEQ ID NO: 10040703 - DNA, 22 bp, Homo sapiens
tgtttcactgaaagccttacta

SEQ ID NO: 10040704 - DNA, 22 bp, Homo sapiens
tgtttcacttaaaaccactgct

SEQ ID NO: 10040705 - DNA, 22 bp, Homo sapiens
tgtttcactaagcagaaatata

SEQ ID NO: 10040706 - DNA, 22 bp, Homo sapiens
ttctgctccaccacttccagca

SEQ ID NO: 10040707 - DNA, 22 bp, Homo sapiens
ttctgtttactcagaaatacaa

SEQ ID NO: 10040708 - DNA, 22 bp, Homo sapiens
ttctgttttagaaataagtagt

SEQ ID NO: 10040709 - DNA, 22 bp, Homo sapiens
ttctggtatgggaaatttcaag

SEQ ID NO: 10040710 - DNA, 22 bp, Homo sapiens
ttcttctttccaattacatggt

SEQ ID NO: 10040711 - DNA, 22 bp, Homo sapiens
ttcttctttcctataattaatt

SEQ ID NO: 10040712 - DNA, 22 bp, Homo sapiens
ttcttgaaggggatataaatag

SEQ ID NO: 10040713 - DNA, 22 bp, Homo sapiens
ttcttgaatagggattgataaa

SEQ ID NO: 10040714 - DNA, 22 bp, Homo sapiens
ttctttaaaatagtgagaaaga

SEQ ID NO: 10040715 - DNA, 22 bp, Homo sapiens
ttctttcagaacacaagtgatt

SEQ ID NO: 10040716 - DNA, 23 bp, Homo sapiens
ttctttcaagaagttcacagtgc

SEQ ID NO: 10040717 - DNA, 22 bp, Homo sapiens
ttgagcaattaggaaataaaga

SEQ ID NO: 10040718 - DNA, 22 bp, Homo sapiens
ttgattctgggctcatttcttt

SEQ ID NO: 10040719 - DNA, 22 bp, Homo sapiens
ttgattctgatcctttgctagc

SEQ ID NO: 10040720 - DNA, 22 bp, Homo sapiens
ttcctcagctgtgtcctggcga

SEQ ID NO: 10040721 - DNA, 22 bp, Homo sapiens
ttccctgcaacctttccctggg

SEQ ID NO: 10040722 - DNA, 22 bp, Homo sapiens
ttcctgtttcatagaaaactga

SEQ ID NO: 10040723 - DNA, 22 bp, Homo sapiens
ttcctgttgtgttagagtcaat

SEQ ID NO: 10040724 - DNA, 22 bp, Homo sapiens
ttggtgtacatctccccttcat

SEQ ID NO: 10040725 - DNA, 20 bp, Homo sapiens
ttggttgagccagggcctgg

SEQ ID NO: 10040726 - DNA, 22 bp, Homo sapiens
ttggttttctaatgtattaagg

SEQ ID NO: 10040727 - DNA, 21 bp, Homo sapiens
ttgtttcccagagctcgctcc

SEQ ID NO: 10040728 - DNA, 19 bp, Homo sapiens
tttctgttagaaggataca

SEQ ID NO: 10040729 - DNA, 22 bp, Homo sapiens
tttcttctaagatttcaaacta

SEQ ID NO: 10040730 - DNA, 20 bp, Homo sapiens
tttcttgtacttggagaagg

SEQ ID NO: 10040731 - DNA, 22 bp, Homo sapiens
tttctcctctccagagtgcagt

SEQ ID NO: 10040732 - DNA, 22 bp, Homo sapiens
tttctcctaactcaaatttaag

SEQ ID NO: 10040733 - DNA, 22 bp, Homo sapiens
tttcctgcacccgctgatgcca

SEQ ID NO: 10040734 - DNA, 21 bp, Homo sapiens
tttcctgccctttgtcatcac

SEQ ID NO: 10040735 - DNA, 22 bp, Homo sapiens
tttcctcttcttcccatgtcat

SEQ ID NO: 10040736 - DNA, 22 bp, Homo sapiens
tttcctctgatgctgacttgga

SEQ ID NO: 10040737 - DNA, 19 bp, Homo sapiens
ttttccttctcctcttaat

SEQ ID NO: 10040738 - DNA, 20 bp, Homo sapiens
ttttccttctgagtatgttg

SEQ ID NO: 10040739 - DNA, 20 bp, Homo sapiens
ttttccttgttgccgctgct

SEQ ID NO: 10040740 - DNA, 22 bp, Homo sapiens
ttttccttctgatactccattt

SEQ ID NO: 10040741 - DNA, 22 bp, Homo sapiens
ttttcctttgattcccagatgt

SEQ ID NO: 10040742 - DNA, 22 bp, Homo sapiens
ttttcctttggaagatgcatat

SEQ ID NO: 10040743 - DNA, 22 bp, Homo sapiens
ttttcctttgaaaggtgagggc

SEQ ID NO: 10040744 - DNA, 22 bp, Homo sapiens
ttttcctttcatcaggacaaag

SEQ ID NO: 10040745 - DNA, 23 bp, Homo sapiens
ttttcctttggacaggctgtatt

SEQ ID NO: 10040746 - DNA, 22 bp, Homo sapiens
tttggagagcagctaggccctt

SEQ ID NO: 10040747 - DNA, 22 bp, Homo sapiens
tttggagatagggcctagcaat

SEQ ID NO: 10040748 - DNA, 22 bp, Homo sapiens
tttgcagtcaaatttgctaaat

SEQ ID NO: 10040749 - DNA, 22 bp, Homo sapiens
tttgttcttagtatctgtgtgc

SEQ ID NO: 10040750 - DNA, 22 bp, Homo sapiens
tttgtttagatggtaaatcagt

SEQ ID NO: 10040751 - DNA, 21 bp, Homo sapiens
atacagaaggtggcaaagtac

SEQ ID NO: 10040752 - DNA, 22 bp, Homo sapiens
ctggccaggctctcacgtggtc

SEQ ID NO: 10040753 - DNA, 22 bp, Homo sapiens
ataggtctgaaagtgtatcctg

SEQ ID NO: 10040754 - DNA, 22 bp, Homo sapiens
agtttcacagaatatgaaggtt

SEQ ID NO: 10040755 - DNA, 22 bp, Homo sapiens
ctgagaggcggaggttgcagtg

SEQ ID NO: 10040756 - DNA, 22 bp, Homo sapiens
agtttcacatgcatggatgtgt

SEQ ID NO: 10040757 - DNA, 22 bp, Homo sapiens
agtttcacagtctgtcattgtt

SEQ ID NO: 10040758 - DNA, 22 bp, Homo sapiens
agtttctgcaaatcatttttat

SEQ ID NO: 10040759 - DNA, 22 bp, Homo sapiens
ctgccctgtctgcagcctggct

SEQ ID NO: 10040760 - DNA, 22 bp, Homo sapiens
ctgtttcaaaactagtacaaca

SEQ ID NO: 10040761 - DNA, 22 bp, Homo sapiens
atcaggccagcaatccctgggc

SEQ ID NO: 10040762 - DNA, 22 bp, Homo sapiens
ctgtttcatgtcttccgcagct

SEQ ID NO: 10040763 - DNA, 22 bp, Homo sapiens
ctgtttcatgaatgcaatttca

SEQ ID NO: 10040764 - DNA, 22 bp, Homo sapiens
ctgtttcagaacttcttaaaaa

SEQ ID NO: 10040765 - DNA, 22 bp, Homo sapiens
ctgtttcagctactgttccatg

SEQ ID NO: 10040766 - DNA, 22 bp, Homo sapiens
ctgtttcatagagttgtgaatt

SEQ ID NO: 10040767 - DNA, 22 bp, Homo sapiens
ctgtttcaaagggtactgtgag

SEQ ID NO: 10040768 - DNA, 19 bp, Homo sapiens
ctgtttcaagtaggaggag

SEQ ID NO: 10040769 - DNA, 22 bp, Homo sapiens
ctgtttcaagtgaagtcagaca

SEQ ID NO: 10040770 - DNA, 22 bp, Homo sapiens
ctgtttcaatttgaggatcagc

SEQ ID NO: 10040771 - DNA, 22 bp, Homo sapiens
ctgtttcaccactggctctttg

SEQ ID NO: 10040772 - DNA, 22 bp, Homo sapiens
ctgtttcacgtgtttaagccca

SEQ ID NO: 10040773 - DNA, 17 bp, Homo sapiens
ctgggcctctgcccttt

SEQ ID NO: 10040774 - DNA, 22 bp, Homo sapiens
ctgggccatggaagtctctgcc

SEQ ID NO: 10040775 - DNA, 22 bp, Homo sapiens
agtgcactgagctaggagtgga

SEQ ID NO: 10040776 - DNA, 22 bp, Homo sapiens
agtgacagtatttgttgccaat

SEQ ID NO: 10040777 - DNA, 22 bp, Homo sapiens
agtgacagtttcaggcattttt

SEQ ID NO: 10040778 - DNA, 22 bp, Homo sapiens
agtgacagtctgatttctcaaa

SEQ ID NO: 10040779 - DNA, 22 bp, Homo sapiens
agtgacagtctcagagatcagg

SEQ ID NO: 10040780 - DNA, 22 bp, Homo sapiens
agtgcagccttctgggccgctt

SEQ ID NO: 10040781 - DNA, 22 bp, Homo sapiens
ctcccagggtctaggctgctgg

SEQ ID NO: 10040782 - DNA, 22 bp, Homo sapiens
agtccaaacaaacttcccgagg

SEQ ID NO: 10040783 - DNA, 22 bp, Homo sapiens
agtccaaagcagatgagggcca

SEQ ID NO: 10040784 - DNA, 22 bp, Homo sapiens
agtctgcactcaggtggaggtc

SEQ ID NO: 10040785 - DNA, 22 bp, Homo sapiens
agtgggctggtggcagggagaa

SEQ ID NO: 10040786 - DNA, 22 bp, Homo sapiens
agtgggcttactgagggagtgt

SEQ ID NO: 10040787 - DNA, 22 bp, Homo sapiens
agtgggcccttgtcacactgat

SEQ ID NO: 10040788 - DNA, 22 bp, Homo sapiens
agtgggcaggcagggtgcgcag

SEQ ID NO: 10040789 - DNA, 22 bp, Homo sapiens
ctctctggtcccagattccaga

SEQ ID NO: 10040790 - DNA, 21 bp, Homo sapiens
agtgtgtgtggaatgagaata

SEQ ID NO: 10040791 - DNA, 22 bp, Homo sapiens
ctgagaggaacatcttatgctt

SEQ ID NO: 10040792 - DNA, 22 bp, Homo sapiens
ctgagaggatgctgcagtggag

SEQ ID NO: 10040793 - DNA, 22 bp, Homo sapiens
ctgagaggatgctgcagtggag

SEQ ID NO: 10040794 - DNA, 22 bp, Homo sapiens
ctgagaggcggagcttgcagtg

SEQ ID NO: 10040795 - DNA, 22 bp, Homo sapiens
ctgagaggcggagcttgcagtg

SEQ ID NO: 10040796 - DNA, 22 bp, Homo sapiens
ctgagaggcggaggttgcagtg

SEQ ID NO: 10040797 - DNA, 22 bp, Homo sapiens
ctgagaggcacaaggcatttcg

SEQ ID NO: 10040798 - DNA, 22 bp, Homo sapiens
ctcttacattcttttactagca

SEQ ID NO: 10040799 - DNA, 19 bp, Homo sapiens
ctcttacagaatagacaca

SEQ ID NO: 10040800 - DNA, 22 bp, Homo sapiens
aggtttccagcatggggaaggc

SEQ ID NO: 10040801 - DNA, 20 bp, Homo sapiens
cctttattatttgtatgatg

SEQ ID NO: 10040802 - DNA, 22 bp, Homo sapiens
cctttattcaattagtcctaat

SEQ ID NO: 10040803 - DNA, 23 bp, Homo sapiens
agtcagagagtgtgagacaactg

SEQ ID NO: 10040804 - DNA, 22 bp, Homo sapiens
ctacaacattatgctttctgtc

SEQ ID NO: 10040805 - DNA, 22 bp, Homo sapiens
agtcagggcctggcctgctgaa

SEQ ID NO: 10040806 - DNA, 22 bp, Homo sapiens
cctgggcagtgctggagttgaa

SEQ ID NO: 10040807 - DNA, 22 bp, Homo sapiens
cctggagcccctctggccagcc

SEQ ID NO: 10040808 - DNA, 22 bp, Homo sapiens
cctggccagcagccccttcctc

SEQ ID NO: 10040809 - DNA, 22 bp, Homo sapiens
cctgcctggatcagccatcctg

SEQ ID NO: 10040810 - DNA, 22 bp, Homo sapiens
cagtggtagaagccaagtagat

SEQ ID NO: 10040811 - DNA, 22 bp, Homo sapiens
cagtttctcaggcctctcccag

SEQ ID NO: 10040812 - DNA, 22 bp, Homo sapiens
aggagggagcttaagccaggca

SEQ ID NO: 10040813 - DNA, 22 bp, Homo sapiens
aggagggagcttaagccaggca

SEQ ID NO: 10040814 - DNA, 22 bp, Homo sapiens
aggagggagcactatatgggga

SEQ ID NO: 10040815 - DNA, 22 bp, Homo sapiens
catattgtctattgctgttttt

SEQ ID NO: 10040816 - DNA, 22 bp, Homo sapiens
cagtggccatggtggcaggggt

SEQ ID NO: 10040817 - DNA, 18 bp, Homo sapiens
cagtggcatagttgagta

SEQ ID NO: 10040818 - DNA, 22 bp, Homo sapiens
cagtggcatacttggctgatat

SEQ ID NO: 10040819 - DNA, 18 bp, Homo sapiens
cagtggcatagttgagta

SEQ ID NO: 10040820 - DNA, 22 bp, Homo sapiens
cagtggcatggttgactgcagt

SEQ ID NO: 10040821 - DNA, 22 bp, Homo sapiens
aggaccctgctcaagcatctcc

SEQ ID NO: 10040822 - DNA, 22 bp, Homo sapiens
aggaccctgaggtctcctgtga

SEQ ID NO: 10040823 - DNA, 22 bp, Homo sapiens
aggaccctgagcgggcatgccg

SEQ ID NO: 10040824 - DNA, 20 bp, Homo sapiens
aggaggggatagaatcaaag

SEQ ID NO: 10040825 - DNA, 22 bp, Homo sapiens
aggagggatagaaaaatacttg

SEQ ID NO: 10040826 - DNA, 21 bp, Homo sapiens
aggagggcacaaggccaggaa

SEQ ID NO: 10040827 - DNA, 22 bp, Homo sapiens
catggagataaactgaaatatt

SEQ ID NO: 10040828 - DNA, 19 bp, Homo sapiens
aggcagcaggccagggatg

SEQ ID NO: 10040829 - DNA, 23 bp, Homo sapiens
aggcagcaggttgtccagggtga

SEQ ID NO: 10040830 - DNA, 22 bp, Homo sapiens
ccaagcagagcagcctctctgg

SEQ ID NO: 10040831 - DNA, 22 bp, Homo sapiens
ccaagcagaaccattcaggcac

SEQ ID NO: 10040832 - DNA, 22 bp, Homo sapiens
ccaagcaggatattctgtgtca

SEQ ID NO: 10040833 - DNA, 16 bp, Homo sapiens
ccaagcagcagcagct

SEQ ID NO: 10040834 - DNA, 21 bp, Homo sapiens
aggcagcaggatccagggaca

SEQ ID NO: 10040835 - DNA, 19 bp, Homo sapiens
aggcagcaggccagggatg

SEQ ID NO: 10040836 - DNA, 21 bp, Homo sapiens
aggcagcaggatccagggaca

SEQ ID NO: 10040837 - DNA, 22 bp, Homo sapiens
caggtgagctctatctagggag

SEQ ID NO: 10040838 - DNA, 22 bp, Homo sapiens
cagggtgcatacccatgcatac

SEQ ID NO: 10040839 - DNA, 22 bp, Homo sapiens
cagggtgcagtgtcgctgctag

SEQ ID NO: 10040840 - DNA, 22 bp, Homo sapiens
caggctcagctctggccagtgc

SEQ ID NO: 10040841 - DNA, 22 bp, Homo sapiens
caggctcagaagccagtggagc

SEQ ID NO: 10040842 - DNA, 22 bp, Homo sapiens
caggctcactgtaaggtcagct

SEQ ID NO: 10040843 - DNA, 22 bp, Homo sapiens
cagggagctggctggcgtgagt

SEQ ID NO: 10040844 - DNA, 22 bp, Homo sapiens
cagggagctggctggctgtgcc

SEQ ID NO: 10040845 - DNA, 22 bp, Homo sapiens
cagggagctttcccaggaccct

SEQ ID NO: 10040846 - DNA, 22 bp, Homo sapiens
cagggagctattagggttagtg

SEQ ID NO: 10040847 - DNA, 22 bp, Homo sapiens
caggagcccagagtcctcagct

SEQ ID NO: 10040848 - DNA, 22 bp, Homo sapiens
agctgcagtcaagctgggccac

SEQ ID NO: 10040849 - DNA, 19 bp, Homo sapiens
agctgcagaccagaagtgc

SEQ ID NO: 10040850 - DNA, 18 bp, Homo sapiens
agctgcagaccaggaggt

SEQ ID NO: 10040851 - DNA, 22 bp, Homo sapiens
cagctctgggtaggaggaatct

SEQ ID NO: 10040852 - DNA, 22 bp, Homo sapiens
cagctctggggcagagtgacta

SEQ ID NO: 10040853 - DNA, 22 bp, Homo sapiens
cccaggggaggtcctcagggaa

SEQ ID NO: 10040854 - DNA, 22 bp, Homo sapiens
cccaggggtaaggcgcagcgtg

SEQ ID NO: 10040855 - DNA, 22 bp, Homo sapiens
agggaagaagctggtagtaggt

SEQ ID NO: 10040856 - DNA, 22 bp, Homo sapiens
aggcttcctggaggaagaggta

SEQ ID NO: 10040857 - DNA, 22 bp, Homo sapiens
agggagtggttaagaaggtgca

SEQ ID NO: 10040858 - DNA, 22 bp, Homo sapiens
ccctggaggaccccaatgtggc

SEQ ID NO: 10040859 - DNA, 22 bp, Homo sapiens
ccctctggctcttctcaggccg

SEQ ID NO: 10040860 - DNA, 22 bp, Homo sapiens
ccctctgctcaggtgcataggc

SEQ ID NO: 10040861 - DNA, 20 bp, Homo sapiens
ccctctgcacatggctgtgg

SEQ ID NO: 10040862 - DNA, 22 bp, Homo sapiens
ccctctgcaggctggacctgcc

SEQ ID NO: 10040863 - DNA, 22 bp, Homo sapiens
ccctctgctcaggtgcataggc

SEQ ID NO: 10040864 - DNA, 22 bp, Homo sapiens
ccctctgcctgcgccctggtgt

SEQ ID NO: 10040865 - DNA, 22 bp, Homo sapiens
agggctctcttggacaactgct

SEQ ID NO: 10040866 - DNA, 22 bp, Homo sapiens
agggccctctggcaggccaggc

SEQ ID NO: 10040867 - DNA, 22 bp, Homo sapiens
ccgaggtcctggacttggccct

SEQ ID NO: 10040868 - DNA, 22 bp, Homo sapiens
ccgaggacattgggcttctgtt

SEQ ID NO: 10040869 - DNA, 21 bp, Homo sapiens
ccgccgctgatagctctgggc

SEQ ID NO: 10040870 - DNA, 22 bp, Homo sapiens
ccctggaggctggaggcagtag

SEQ ID NO: 10040871 - DNA, 22 bp, Homo sapiens
cctcctggaaaaattccctggc

SEQ ID NO: 10040872 - DNA, 22 bp, Homo sapiens
aggggagagttaatgtgaatgt

SEQ ID NO: 10040873 - DNA, 22 bp, Homo sapiens
aggccctggcccccagagattc

SEQ ID NO: 10040874 - DNA, 22 bp, Homo sapiens
aggccctggcactgcctgggag

SEQ ID NO: 10040875 - DNA, 22 bp, Homo sapiens
ccagcttttcagaatctgcctg

SEQ ID NO: 10040876 - DNA, 22 bp, Homo sapiens
aggcccagctggacaaactgct

SEQ ID NO: 10040877 - DNA, 21 bp, Homo sapiens
ccagctttcccaagtcccttt

SEQ ID NO: 10040878 - DNA, 22 bp, Homo sapiens
ccagcttggagtaacaaatggt

SEQ ID NO: 10040879 - DNA, 21 bp, Homo sapiens
aggcccagagtcttgggggga

SEQ ID NO: 10040880 - DNA, 22 bp, Homo sapiens
aggcccagagcaggaaagggtt

SEQ ID NO: 10040881 - DNA, 22 bp, Homo sapiens
aggcccagagagccagttagtg

SEQ ID NO: 10040882 - DNA, 22 bp, Homo sapiens
ccagcctgaaatgcctcatcct

SEQ ID NO: 10040883 - DNA, 22 bp, Homo sapiens
aggcccagcccgtcctcgtgct

SEQ ID NO: 10040884 - DNA, 19 bp, Homo sapiens
aggcccagcgctgggggct

SEQ ID NO: 10040885 - DNA, 22 bp, Homo sapiens
ccacaggacggaggtctggccg

SEQ ID NO: 10040886 - DNA, 22 bp, Homo sapiens
ccagcagagggcgcttcacacc

SEQ ID NO: 10040887 - DNA, 22 bp, Homo sapiens
ccagcagagctggaagtgtgct

SEQ ID NO: 10040888 - DNA, 22 bp, Homo sapiens
ccagcagaggcatcatccttcc

SEQ ID NO: 10040889 - DNA, 19 bp, Homo sapiens
ccagcagacacagctgccc

SEQ ID NO: 10040890 - DNA, 22 bp, Homo sapiens
ccagcagagcatggggaggaag

SEQ ID NO: 10040891 - DNA, 22 bp, Homo sapiens
ccagcagagctcaaacttcctg

SEQ ID NO: 10040892 - DNA, 19 bp, Homo sapiens
ccagcagaagccactcctg

SEQ ID NO: 10040893 - DNA, 22 bp, Homo sapiens
ccagcagaagctcccgctgggt

SEQ ID NO: 10040894 - DNA, 22 bp, Homo sapiens
ccagcagacacacaggcgtggg

SEQ ID NO: 10040895 - DNA, 22 bp, Homo sapiens
cagaaaatagagtttctctgag

SEQ ID NO: 10040896 - DNA, 22 bp, Homo sapiens
cagacacagatatgcatatggc

SEQ ID NO: 10040897 - DNA, 22 bp, Homo sapiens
gggaggcagtgctggaggctgg

SEQ ID NO: 10040898 - DNA, 22 bp, Homo sapiens
gggatgagagtagggtgtgaaa

SEQ ID NO: 10040899 - DNA, 22 bp, Homo sapiens
cagagcagtggagagtaggtct

SEQ ID NO: 10040900 - DNA, 22 bp, Homo sapiens
gggcaggtacaagatgcttctt

SEQ ID NO: 10040901 - DNA, 21 bp, Homo sapiens
ggggcctctccacacagccgg

SEQ ID NO: 10040902 - DNA, 22 bp, Homo sapiens
ggggcctctgcagtcacgctgg

SEQ ID NO: 10040903 - DNA, 22 bp, Homo sapiens
ggggcctgtagagcttcaggga

SEQ ID NO: 10040904 - DNA, 22 bp, Homo sapiens
gggtccctggaattacttgaca

SEQ ID NO: 10040905 - DNA, 22 bp, Homo sapiens
gtactttcaggctttcccttaa

SEQ ID NO: 10040906 - DNA, 22 bp, Homo sapiens
cagccagctggtgcggcagagc

SEQ ID NO: 10040907 - DNA, 22 bp, Homo sapiens
gtcagcagaaacgccacatgca

SEQ ID NO: 10040908 - DNA, 23 bp, Homo sapiens
gtgagcagcaccatgaggctaga

SEQ ID NO: 10040909 - DNA, 22 bp, Homo sapiens
gtgagagggctgggctcatgat

SEQ ID NO: 10040910 - DNA, 22 bp, Homo sapiens
caagaataaaatacatgttgat

SEQ ID NO: 10040911 - DNA, 22 bp, Homo sapiens
caagaataaccagacaatagca

SEQ ID NO: 10040912 - DNA, 22 bp, Homo sapiens
caagctctttaaacttatgtca

SEQ ID NO: 10040913 - DNA, 22 bp, Homo sapiens
caacaagcgctcagagcaaagc

SEQ ID NO: 10040914 - DNA, 22 bp, Homo sapiens
caacactgacaatggactgatt

SEQ ID NO: 10040915 - DNA, 22 bp, Homo sapiens
gctgccctgactccagcagcct

SEQ ID NO: 10040916 - DNA, 22 bp, Homo sapiens
cacacaggagagtgctggaggt

SEQ ID NO: 10040917 - DNA, 22 bp, Homo sapiens
caattctttgtagaagctctcc

SEQ ID NO: 10040918 - DNA, 22 bp, Homo sapiens
caattgctttgtggaagccttt

SEQ ID NO: 10040919 - DNA, 22 bp, Homo sapiens
cactgcactccagcctggcgac

SEQ ID NO: 10040920 - DNA, 22 bp, Homo sapiens
caccaggcacatagtaggcact

SEQ ID NO: 10040921 - DNA, 22 bp, Homo sapiens
cacttcagctacaatcacatga

SEQ ID NO: 10040922 - DNA, 22 bp, Homo sapiens
cacttcaaatatggcttcatga

SEQ ID NO: 10040923 - DNA, 22 bp, Homo sapiens
cactgcactccagcttgggcaa

SEQ ID NO: 10040924 - DNA, 22 bp, Homo sapiens
caccactgcttcctgccatctg

SEQ ID NO: 10040925 - DNA, 22 bp, Homo sapiens
cacattaaatagtagggatgct

SEQ ID NO: 10040926 - DNA, 22 bp, Homo sapiens
ggcaaggtgctacagacagtga

SEQ ID NO: 10040927 - DNA, 22 bp, Homo sapiens
cacaggcagccttgtagaagaa

SEQ ID NO: 10040928 - DNA, 23 bp, Homo sapiens
cacaggcagaaatcaagacggta

SEQ ID NO: 10040929 - DNA, 22 bp, Homo sapiens
attaaattggatctgcatagtt

SEQ ID NO: 10040930 - DNA, 20 bp, Homo sapiens
gatggatttcaacacctttc

SEQ ID NO: 10040931 - DNA, 22 bp, Homo sapiens
gagtggggaaagccaggacaga

SEQ ID NO: 10040932 - DNA, 22 bp, Homo sapiens
gagtgggcttggggagagtttg

SEQ ID NO: 10040933 - DNA, 20 bp, Homo sapiens
gagtgggccatggagtgaga

SEQ ID NO: 10040934 - DNA, 22 bp, Homo sapiens
gagtggggcgaagtcggcgagt

SEQ ID NO: 10040935 - DNA, 22 bp, Homo sapiens
attagttgtgtggttctcaatt

SEQ ID NO: 10040936 - DNA, 22 bp, Homo sapiens
attatataaaattctggaagct

SEQ ID NO: 10040937 - DNA, 22 bp, Homo sapiens
attatataggacttgcccttcc

SEQ ID NO: 10040938 - DNA, 22 bp, Homo sapiens
attatcagccgtcccactacat

SEQ ID NO: 10040939 - DNA, 22 bp, Homo sapiens
attatcagaaattcaaagggtg

SEQ ID NO: 10040940 - DNA, 22 bp, Homo sapiens
gcacacagaatcagtgggcata

SEQ ID NO: 10040941 - DNA, 22 bp, Homo sapiens
gcaccaggcagctgagcaggcc

SEQ ID NO: 10040942 - DNA, 22 bp, Homo sapiens
gcacagggcctggcacataaga

SEQ ID NO: 10040943 - DNA, 22 bp, Homo sapiens
gcacagggccctgtgcgtaggt

SEQ ID NO: 10040944 - DNA, 22 bp, Homo sapiens
gcacccagaataaggacaggac

SEQ ID NO: 10040945 - DNA, 22 bp, Homo sapiens
attcttttttaaggaatagaac

SEQ ID NO: 10040946 - DNA, 22 bp, Homo sapiens
attgcacatctgcactacagcc

SEQ ID NO: 10040947 - DNA, 22 bp, Homo sapiens
attcttttaaatggcagtagta

SEQ ID NO: 10040948 - DNA, 22 bp, Homo sapiens
attcttttgtcctagcttgata

SEQ ID NO: 10040949 - DNA, 22 bp, Homo sapiens
attcttttaagccccagggatt

SEQ ID NO: 10040950 - DNA, 22 bp, Homo sapiens
attcttttcccaactgctttaa

SEQ ID NO: 10040951 - DNA, 22 bp, Homo sapiens
attctgcatggtggtgtctctg

SEQ ID NO: 10040952 - DNA, 22 bp, Homo sapiens
attctcttctgatgtcttgcca

SEQ ID NO: 10040953 - DNA, 19 bp, Homo sapiens
gccttcccaccacccgtcc

SEQ ID NO: 10040954 - DNA, 22 bp, Homo sapiens
gccttcccaccctgcgaggctg

SEQ ID NO: 10040955 - DNA, 22 bp, Homo sapiens
gccttcccaagacgcctgagtt

SEQ ID NO: 10040956 - DNA, 22 bp, Homo sapiens
gccttccctggctaggcaagca

SEQ ID NO: 10040957 - DNA, 22 bp, Homo sapiens
gccttccctctcatcctgctgg

SEQ ID NO: 10040958 - DNA, 22 bp, Homo sapiens
caaaagcagttctatctgagtt

SEQ ID NO: 10040959 - DNA, 21 bp, Homo sapiens
caaaagagactgattcttgga

SEQ ID NO: 10040960 - DNA, 22 bp, Homo sapiens
gccatgcttggtatgctgtgag

SEQ ID NO: 10040961 - DNA, 22 bp, Homo sapiens
gcccagtctcttctggccctgt

SEQ ID NO: 10040962 - DNA, 22 bp, Homo sapiens
gcccagggtgaagtgcagttgt

SEQ ID NO: 10040963 - DNA, 17 bp, Homo sapiens
gccctgcctgctgccct

SEQ ID NO: 10040964 - DNA, 22 bp, Homo sapiens
gaggttccagacagcttaggga

SEQ ID NO: 10040965 - DNA, 22 bp, Homo sapiens
gaggttccccattgtactggct

SEQ ID NO: 10040966 - DNA, 22 bp, Homo sapiens
gaggagggcagttcctctttta

SEQ ID NO: 10040967 - DNA, 22 bp, Homo sapiens
gaggagggctttgttgatgtta

SEQ ID NO: 10040968 - DNA, 22 bp, Homo sapiens
gaggaggggacagtacttgtgc

SEQ ID NO: 10040969 - DNA, 22 bp, Homo sapiens
gaggagggcctggtgtcccttc

SEQ ID NO: 10040970 - DNA, 23 bp, Homo sapiens
gaggagggtcgtgctgtgttcct

SEQ ID NO: 10040971 - DNA, 22 bp, Homo sapiens
gaggaggggcacttgtctccta

SEQ ID NO: 10040972 - DNA, 22 bp, Homo sapiens
gaggaggggacagtacttgtgc

SEQ ID NO: 10040973 - DNA, 18 bp, Homo sapiens
gaggcacatagttggggc

SEQ ID NO: 10040974 - DNA, 22 bp, Homo sapiens
atgtatcaactgcaggcaagtt

SEQ ID NO: 10040975 - DNA, 22 bp, Homo sapiens
gaggcacagtgtttggtcagtg

SEQ ID NO: 10040976 - DNA, 22 bp, Homo sapiens
gaggcacagtcccgaggcaagg

SEQ ID NO: 10040977 - DNA, 22 bp, Homo sapiens
atgtatgttagtgtattatcta

SEQ ID NO: 10040978 - DNA, 22 bp, Homo sapiens
atgtatgtttctatatatgaca

SEQ ID NO: 10040979 - DNA, 22 bp, Homo sapiens
atgtatgtagtgtacatataca

SEQ ID NO: 10040980 - DNA, 22 bp, Homo sapiens
atgtatcagaaatagcattggc

SEQ ID NO: 10040981 - DNA, 22 bp, Homo sapiens
atgtatcagataaagcatgtgg

SEQ ID NO: 10040982 - DNA, 22 bp, Homo sapiens
atggcagaagtcaagatgagtt

SEQ ID NO: 10040983 - DNA, 22 bp, Homo sapiens
gagaagttctaattggctcttt

SEQ ID NO: 10040984 - DNA, 22 bp, Homo sapiens
gagaagttcattactctgccca

SEQ ID NO: 10040985 - DNA, 22 bp, Homo sapiens
gagaagtttcttcctaggtttg

SEQ ID NO: 10040986 - DNA, 22 bp, Homo sapiens
gagaagtttctggtttgcatag

SEQ ID NO: 10040987 - DNA, 16 bp, Homo sapiens
atgctgctattagagg

SEQ ID NO: 10040988 - DNA, 22 bp, Homo sapiens
atgggagtgtgcttgaggagtt

SEQ ID NO: 10040989 - DNA, 22 bp, Homo sapiens
gagctgcatgcggaaacctgtt

SEQ ID NO: 10040990 - DNA, 22 bp, Homo sapiens
gagctgcagaaggggttttcct

SEQ ID NO: 10040991 - DNA, 22 bp, Homo sapiens
gagctgcacatctgaggctaat

SEQ ID NO: 10040992 - DNA, 22 bp, Homo sapiens
gagcccagtctgctcctgcgcc

SEQ ID NO: 10040993 - DNA, 22 bp, Homo sapiens
gacagcttagtgaaaatgtaaa

SEQ ID NO: 10040994 - DNA, 22 bp, Homo sapiens
gaaggagggagcggcgcggatt

SEQ ID NO: 10040995 - DNA, 22 bp, Homo sapiens
gaagctccgtactatgactttt

SEQ ID NO: 10040996 - DNA, 22 bp, Homo sapiens
atgagcagtttttaagtagcaa

SEQ ID NO: 10040997 - DNA, 22 bp, Homo sapiens
gaagagatgacaaaggagcatg

SEQ ID NO: 10040998 - DNA, 22 bp, Homo sapiens
atgagaatggtgattctgcaga

SEQ ID NO: 10040999 - DNA, 22 bp, Homo sapiens
atctttggatcgctcccccttc

SEQ ID NO: 10041000 - DNA, 22 bp, Homo sapiens
atctttggccacttgtgctgca

SEQ ID NO: 10041001 - DNA, 20 bp, Homo sapiens
atctttggctcagaagcctt

SEQ ID NO: 10041002 - DNA, 22 bp, Homo sapiens
atctttgggatatttgtgatta

SEQ ID NO: 10041003 - DNA, 22 bp, Homo sapiens
atctttggacggtcccaactga

SEQ ID NO: 10041004 - DNA, 22 bp, Homo sapiens
atctttggaaagccaagcacag

SEQ ID NO: 10041005 - DNA, 22 bp, Homo sapiens
cttctcctgtaagaagatcaaa

SEQ ID NO: 10041006 - DNA, 22 bp, Homo sapiens
aattacctgtcatacatcaagc

SEQ ID NO: 10041007 - DNA, 22 bp, Homo sapiens
aatgttgagaaatgactactct

SEQ ID NO: 10041008 - DNA, 20 bp, Homo sapiens
agcaccagtgggggcagccc

SEQ ID NO: 10041009 - DNA, 21 bp, Homo sapiens
agcaccagttttatgccaggc

SEQ ID NO: 10041010 - DNA, 22 bp, Homo sapiens
acaattaccctggcttgataaa

SEQ ID NO: 10041011 - DNA, 22 bp, Homo sapiens
acaattctctcatatcttatta

SEQ ID NO: 10041012 - DNA, 22 bp, Homo sapiens
agaggccccaggtgagcatgcc

SEQ ID NO: 10041013 - DNA, 22 bp, Homo sapiens
acaaatgagaatgtagacagag

SEQ ID NO: 10041014 - DNA, 22 bp, Homo sapiens
agcagtggtccccaacctttct

SEQ ID NO: 10041015 - DNA, 22 bp, Homo sapiens
acactgtgcagattccctgtga

SEQ ID NO: 10041016 - DNA, 22 bp, Homo sapiens
agcagtgggggagtgttagttt

SEQ ID NO: 10041017 - DNA, 22 bp, Homo sapiens
agcagtggctggatggtgtgct

SEQ ID NO: 10041018 - DNA, 22 bp, Homo sapiens
agcagtgggtggtttttgagca

SEQ ID NO: 10041019 - DNA, 22 bp, Homo sapiens
acacatatctaagatagatgac

SEQ ID NO: 10041020 - DNA, 22 bp, Homo sapiens
acacatatgccattacagcaaa

SEQ ID NO: 10041021 - DNA, 23 bp, Homo sapiens
acacatatattcagatacagatg

SEQ ID NO: 10041022 - DNA, 22 bp, Homo sapiens
acacatatatttgcatatacac

SEQ ID NO: 10041023 - DNA, 22 bp, Homo sapiens
agcagcagtcatgcctatgctc

SEQ ID NO: 10041024 - DNA, 22 bp, Homo sapiens
agcagcagtatccttccccggc

SEQ ID NO: 10041025 - DNA, 22 bp, Homo sapiens
agcagcagtacatataagacta

SEQ ID NO: 10041026 - DNA, 22 bp, Homo sapiens
agcagcaggtgacctcgatgcc

SEQ ID NO: 10041027 - DNA, 22 bp, Homo sapiens
agcagcagtgttctggaattct

SEQ ID NO: 10041028 - DNA, 22 bp, Homo sapiens
agcagcagtgtgtggtcatgtt

SEQ ID NO: 10041029 - DNA, 23 bp, Homo sapiens
agcagcagtgagaggtgtcttac

SEQ ID NO: 10041030 - DNA, 22 bp, Homo sapiens
agcagcagtgtggtttggggaa

SEQ ID NO: 10041031 - DNA, 22 bp, Homo sapiens
agcagcagtgacagccgaaagc

SEQ ID NO: 10041032 - DNA, 22 bp, Homo sapiens
agcagcagtcctttgtgtaatt

SEQ ID NO: 10041033 - DNA, 22 bp, Homo sapiens
agcaccctcagccttatccaga

SEQ ID NO: 10041034 - DNA, 22 bp, Homo sapiens
agcaccctttgtgagcataagt

SEQ ID NO: 10041035 - DNA, 22 bp, Homo sapiens
acaattctgatggtttcccagt

SEQ ID NO: 10041036 - DNA, 22 bp, Homo sapiens
acaattctgtggttgtctgtgg

SEQ ID NO: 10041037 - DNA, 22 bp, Homo sapiens
acagcaagacccctagcatggt

SEQ ID NO: 10041038 - DNA, 20 bp, Homo sapiens
agcctgccagctggcccaga

SEQ ID NO: 10041039 - DNA, 17 bp, Homo sapiens
agcctgccccatgctgc

SEQ ID NO: 10041040 - DNA, 22 bp, Homo sapiens
agcctgcctcagactcaggata

SEQ ID NO: 10041041 - DNA, 22 bp, Homo sapiens
agcctgcctgtgaggctttgag

SEQ ID NO: 10041042 - DNA, 21 bp, Homo sapiens
acagcaagccttcacatgagt

SEQ ID NO: 10041043 - DNA, 23 bp, Homo sapiens
acagcaagaggaccagatgtgag

SEQ ID NO: 10041044 - DNA, 22 bp, Homo sapiens
acagcaggatttggcgatgttg

SEQ ID NO: 10041045 - DNA, 22 bp, Homo sapiens
agctctgggctgacatgctccc

SEQ ID NO: 10041046 - DNA, 22 bp, Homo sapiens
agcccagctgctatgtacctgg

SEQ ID NO: 10041047 - DNA, 22 bp, Homo sapiens
agcccagctgcctgcctgctgt

SEQ ID NO: 10041048 - DNA, 22 bp, Homo sapiens
agcccagctcctccacagaata

SEQ ID NO: 10041049 - DNA, 18 bp, Homo sapiens
agcccagcggagtgaatc

SEQ ID NO: 10041050 - DNA, 22 bp, Homo sapiens
agcccagcggagcgggcccggg

SEQ ID NO: 10041051 - DNA, 22 bp, Homo sapiens
agcccagcctgattctacaccc

SEQ ID NO: 10041052 - DNA, 22 bp, Homo sapiens
agcccagcttccttctgtctct

SEQ ID NO: 10041053 - DNA, 19 bp, Homo sapiens
agcccagcttatttgtcag

SEQ ID NO: 10041054 - DNA, 22 bp, Homo sapiens
acagagtctgacaggtaggcgc

SEQ ID NO: 10041055 - DNA, 22 bp, Homo sapiens
acagagtcctagctgcaaagaa

SEQ ID NO: 10041056 - DNA, 19 bp, Homo sapiens
acagagtccagaggaaagg

SEQ ID NO: 10041057 - DNA, 22 bp, Homo sapiens
acagagcagttctggagctggc

SEQ ID NO: 10041058 - DNA, 22 bp, Homo sapiens
accatgtcatttattggccaaa

SEQ ID NO: 10041059 - DNA, 22 bp, Homo sapiens
accatcagtcattgtcagtggg

SEQ ID NO: 10041060 - DNA, 22 bp, Homo sapiens
aaggtgagagggaaattttcca

SEQ ID NO: 10041061 - DNA, 22 bp, Homo sapiens
aaggtgaggattttgttctgct

SEQ ID NO: 10041062 - DNA, 17 bp, Homo sapiens
aaggtgagagctgttct

SEQ ID NO: 10041063 - DNA, 22 bp, Homo sapiens
accccaggaagtggaggtcatg

SEQ ID NO: 10041064 - DNA, 22 bp, Homo sapiens
accccaggagctgtgcctagtc

SEQ ID NO: 10041065 - DNA, 22 bp, Homo sapiens
accccaggtctccaggctctgg

SEQ ID NO: 10041066 - DNA, 22 bp, Homo sapiens
accccaggtcatctgagagtcc

SEQ ID NO: 10041067 - DNA, 22 bp, Homo sapiens
accccaggtccaggttacagag

SEQ ID NO: 10041068 - DNA, 23 bp, Homo sapiens
accccaggcatcgcattcctctt

SEQ ID NO: 10041069 - DNA, 22 bp, Homo sapiens
accccaggcccagggaagaggc

SEQ ID NO: 10041070 - DNA, 22 bp, Homo sapiens
accccagggctgccagcctcct

SEQ ID NO: 10041071 - DNA, 22 bp, Homo sapiens
aagggccattgctgagagcagt

SEQ ID NO: 10041072 - DNA, 22 bp, Homo sapiens
aagggactttgtcagctttcca

SEQ ID NO: 10041073 - DNA, 22 bp, Homo sapiens
aaggaaatagatgcagatggta

SEQ ID NO: 10041074 - DNA, 22 bp, Homo sapiens
aaggaaagattctctctctaga

SEQ ID NO: 10041075 - DNA, 22 bp, Homo sapiens
aaggcagcctctgccagccggg

SEQ ID NO: 10041076 - DNA, 22 bp, Homo sapiens
acagttctgcctgtttgagaag

SEQ ID NO: 10041077 - DNA, 22 bp, Homo sapiens
aaggcagcttcaccacagcatt

SEQ ID NO: 10041078 - DNA, 22 bp, Homo sapiens
aaggaaatgaggttgatggatg

SEQ ID NO: 10041079 - DNA, 22 bp, Homo sapiens
aagtttctacatctccatcata

SEQ ID NO: 10041080 - DNA, 22 bp, Homo sapiens
aagtttctattattacattcgt

SEQ ID NO: 10041081 - DNA, 22 bp, Homo sapiens
aagttggagctggagctatgga

SEQ ID NO: 10041082 - DNA, 22 bp, Homo sapiens
aagtcagagcaactgagacatt

SEQ ID NO: 10041083 - DNA, 22 bp, Homo sapiens
aagtcaggacttatgctacctg

SEQ ID NO: 10041084 - DNA, 22 bp, Homo sapiens
aatatatagaagtacccgttgt

SEQ ID NO: 10041085 - DNA, 22 bp, Homo sapiens
aatatcagaatgtaatggtcct

SEQ ID NO: 10041086 - DNA, 20 bp, Homo sapiens
agaaatactttggtataatg

SEQ ID NO: 10041087 - DNA, 22 bp, Homo sapiens
agaagggaactcagagatgatt

SEQ ID NO: 10041088 - DNA, 22 bp, Homo sapiens
aaagtatttttgacaggcatta

SEQ ID NO: 10041089 - DNA, 22 bp, Homo sapiens
aaagtgctttcccacatttgtt

SEQ ID NO: 10041090 - DNA, 22 bp, Homo sapiens
aaagtgctttaggatatttgga

SEQ ID NO: 10041091 - DNA, 22 bp, Homo sapiens
aaagctttgtaaataaacaggt

SEQ ID NO: 10041092 - DNA, 22 bp, Homo sapiens
aaagggcctccgcctgggcagg

SEQ ID NO: 10041093 - DNA, 22 bp, Homo sapiens
aaaggtttccgagctttaattt

SEQ ID NO: 10041094 - DNA, 22 bp, Homo sapiens
aacagcagcaagtaagcaggtc

SEQ ID NO: 10041095 - DNA, 22 bp, Homo sapiens
aacagcaatagcactattcatt

SEQ ID NO: 10041096 - DNA, 22 bp, Homo sapiens
aaagtgttgggattacaggcat

SEQ ID NO: 10041097 - DNA, 22 bp, Homo sapiens
aagcatgggaggcctggaggag

SEQ ID NO: 10041098 - DNA, 18 bp, Homo sapiens
aaatgtactgtccatggc

SEQ ID NO: 10041099 - DNA, 22 bp, Homo sapiens
aaatgtattgcataggatattt

SEQ ID NO: 10041100 - DNA, 22 bp, Homo sapiens
aaacagtgccaggcagatgcca

SEQ ID NO: 10041101 - DNA, 22 bp, Homo sapiens
aaacagtgcctggcatggagga

SEQ ID NO: 10041102 - DNA, 22 bp, Homo sapiens
aaacagtgtgtttcagagaggc

SEQ ID NO: 10041103 - DNA, 22 bp, Homo sapiens
aaatgcactctgcttctgtgac

SEQ ID NO: 10041104 - DNA, 22 bp, Homo sapiens
aaaagagaatcctgtacagaga

SEQ ID NO: 10041105 - DNA, 22 bp, Homo sapiens
aaacactgtgggacatcttact

SEQ ID NO: 10041106 - DNA, 22 bp, Homo sapiens
aaacactgtgtcaaactggggc

SEQ ID NO: 10041107 - DNA, 21 bp, Homo sapiens
aaacagagctgagtaatagat

SEQ ID NO: 10041108 - DNA, 22 bp, Homo sapiens
aaaaaccattgtcttcagtctc

SEQ ID NO: 10041109 - DNA, 22 bp, Homo sapiens
aaaaaattatcatagttcctga

SEQ ID NO: 10041110 - DNA, 22 bp, Homo sapiens
aaaaacactgggctgggagtca

SEQ ID NO: 10041111 - DNA, 22 bp, Homo sapiens
aacaaacagttaagtgtggatg

SEQ ID NO: 10041112 - DNA, 22 bp, Homo sapiens
aaatgtgttcctttgctacaga

SEQ ID NO: 10041113 - DNA, 22 bp, Homo sapiens
aaatgtgtcagtttcattctct

SEQ ID NO: 10041114 - DNA, 22 bp, Homo sapiens
aagtccaaggctgggtgcagtg

SEQ ID NO: 10041115 - DNA, 22 bp, Homo sapiens
aagtccaaggtcaccattcaca

SEQ ID NO: 10041116 - DNA, 22 bp, Homo sapiens
aagtccagctctaaatatctga

SEQ ID NO: 10041117 - DNA, 22 bp, Homo sapiens
aacagcaggcaccaaggctatg

SEQ ID NO: 10041118 - DNA, 22 bp, Homo sapiens
aacagcagttacttttgcatca

SEQ ID NO: 10041119 - DNA, 22 bp, Homo sapiens
aacagcagggatggggtggcca

SEQ ID NO: 10041120 - DNA, 22 bp, Homo sapiens
aacagcagggacttgaatggaa

SEQ ID NO: 10041121 - DNA, 22 bp, Homo sapiens
aacagcagggaaattccaagtc

SEQ ID NO: 10041122 - DNA, 22 bp, Homo sapiens
aacactgacgacgtgaactaaa

SEQ ID NO: 10041123 - DNA, 22 bp, Homo sapiens
aaggtatagcttgcatacagaa

SEQ ID NO: 10041124 - DNA, 22 bp, Homo sapiens
aaggtatatgtacaatagacat

SEQ ID NO: 10041125 - DNA, 22 bp, Homo sapiens
aacactgacctctaccctcagt

SEQ ID NO: 10041126 - DNA, 22 bp, Homo sapiens
aacactgacctctaccctcagt

SEQ ID NO: 10041127 - DNA, 22 bp, Homo sapiens
aacactgacgacgtgaactaaa

SEQ ID NO: 10041128 - DNA, 22 bp, Homo sapiens
aacactgaagtagtgaatactg

SEQ ID NO: 10041129 - DNA, 22 bp, Homo sapiens
aacactgaaatgtcttaagatt

SEQ ID NO: 10041130 - DNA, 22 bp, Homo sapiens
aacactgaaatgtcttaagatt

SEQ ID NO: 10041131 - DNA, 19 bp, Homo sapiens
aacaccagagtcaggagtc

SEQ ID NO: 10041132 - DNA, 22 bp, Homo sapiens
aacaaatggaacacaaatcttt

SEQ ID NO: 10041133 - DNA, 22 bp, Homo sapiens
aaccactggtctgaggtacaag

SEQ ID NO: 10041134 - DNA, 22 bp, Homo sapiens
aataagaaagagtcagcttcag

SEQ ID NO: 10041135 - DNA, 22 bp, Homo sapiens
aatgatcattataaagtgctct

SEQ ID NO: 10041136 - DNA, 20 bp, Homo sapiens
aatgatcagcatagcaagga

SEQ ID NO: 10041137 - DNA, 22 bp, Homo sapiens
aatgatcactgcagttgatgag

SEQ ID NO: 10041138 - DNA, 22 bp, Homo sapiens
aatgatcacctggtaaagagag

SEQ ID NO: 10041139 - DNA, 23 bp, Homo sapiens
acagacaacactgatgagagaaa

SEQ ID NO: 10041140 - DNA, 22 bp, Homo sapiens
aagcagcatcctgggcagacct

SEQ ID NO: 10041141 - DNA, 22 bp, Homo sapiens
aagcagcattgtggtaggggag

SEQ ID NO: 10041142 - DNA, 22 bp, Homo sapiens
acagcagctaacccctgggcca

SEQ ID NO: 10041143 - DNA, 22 bp, Homo sapiens
aagcacacttggctctgtgtac

SEQ ID NO: 10041144 - DNA, 22 bp, Homo sapiens
aacttcagttgagaaaggcatg

SEQ ID NO: 10041145 - DNA, 22 bp, Homo sapiens
aacttcatgggttcaaagctgg

SEQ ID NO: 10041146 - DNA, 22 bp, Homo sapiens
aacttcagggacagaaaagagc

SEQ ID NO: 10041147 - DNA, 20 bp, Homo sapiens
aagaagttggtaagcagtgc

SEQ ID NO: 10041148 - DNA, 18 bp, Homo sapiens
aagaagttggccaaagag

SEQ ID NO: 10041149 - DNA, 22 bp, Homo sapiens
aagacagatgcaacctgctagc

SEQ ID NO: 10041150 - DNA, 22 bp, Homo sapiens
aattgtcttgaaagcaacactt

SEQ ID NO: 10041151 - DNA, 22 bp, Homo sapiens
aattgttgagcataaattatcg

SEQ ID NO: 10041152 - DNA, 22 bp, Homo sapiens
acaaagatgtttaaagcattta

SEQ ID NO: 10041153 - DNA, 22 bp, Homo sapiens
aagagctggatgaagaaatcaa

SEQ ID NO: 10041154 - DNA, 22 bp, Homo sapiens
aagagctgattaagtcatgagg

SEQ ID NO: 10041155 - DNA, 19 bp, Homo sapiens
aagagcagggaaagaattg

SEQ ID NO: 10041156 - DNA, 22 bp, Homo sapiens
agaggtgacataggagaggctc

SEQ ID NO: 10041157 - DNA, 22 bp, Homo sapiens
agaggtgaaagaatttggctct

SEQ ID NO: 10041158 - DNA, 22 bp, Homo sapiens
atttccttcatcagcctatcct

SEQ ID NO: 10041159 - DNA, 22 bp, Homo sapiens
atttccttcagtgtttaatact

SEQ ID NO: 10041160 - DNA, 22 bp, Homo sapiens
agagggagaaaagaatcagttg

SEQ ID NO: 10041161 - DNA, 22 bp, Homo sapiens
agagggagaagctaaaataact

SEQ ID NO: 10041162 - DNA, 21 bp, Homo sapiens
agagggagagtggcccttcca

SEQ ID NO: 10041163 - DNA, 22 bp, Homo sapiens
agagggaaatccaggagtgctt

SEQ ID NO: 10041164 - DNA, 22 bp, Homo sapiens
attataggcttgagccaccgtg

SEQ ID NO: 10041165 - DNA, 22 bp, Homo sapiens
agaggaggctctgggatcgtcc

SEQ ID NO: 10041166 - DNA, 22 bp, Homo sapiens
agaggagctgggaggccctcgt

SEQ ID NO: 10041167 - DNA, 22 bp, Homo sapiens
agaagtttgaaattaggagaaa

SEQ ID NO: 10041168 - DNA, 22 bp, Homo sapiens
agaagtttctttgaacgtgtag

SEQ ID NO: 10041169 - DNA, 22 bp, Homo sapiens
agaagtttctctgaacgtgtag

SEQ ID NO: 10041170 - DNA, 22 bp, Homo sapiens
agaagtttgctcacttgggaca

SEQ ID NO: 10041171 - DNA, 22 bp, Homo sapiens
agaagtttggatgccatcatag

SEQ ID NO: 10041172 - DNA, 22 bp, Homo sapiens
agaagtttgggggcgaaggcag

SEQ ID NO: 10041173 - DNA, 20 bp, Homo sapiens
agaagtttgggggtgtggag

SEQ ID NO: 10041174 - DNA, 22 bp, Homo sapiens
agaagtttggtcctataaactc

SEQ ID NO: 10041175 - DNA, 22 bp, Homo sapiens
agaagtttaaccaggtgctact

SEQ ID NO: 10041176 - DNA, 22 bp, Homo sapiens
agaagtttccagtctagtaagg

SEQ ID NO: 10041177 - DNA, 22 bp, Homo sapiens
agaagtttcacaatgggtttta

SEQ ID NO: 10041178 - DNA, 22 bp, Homo sapiens
agaagtttatttatgccccaat

SEQ ID NO: 10041179 - DNA, 22 bp, Homo sapiens
agaagtcaatagttgtttgatg

SEQ ID NO: 10041180 - DNA, 22 bp, Homo sapiens
agacagctgctcgcagagctat

SEQ ID NO: 10041181 - DNA, 22 bp, Homo sapiens
agagcagtgctgaagagtaggg

SEQ ID NO: 10041182 - DNA, 22 bp, Homo sapiens
atggccagccactcctgatggc

SEQ ID NO: 10041183 - DNA, 22 bp, Homo sapiens
atggccagcccttcccgcagct

SEQ ID NO: 10041184 - DNA, 22 bp, Homo sapiens
atggccagcttataggggctca

SEQ ID NO: 10041185 - DNA, 22 bp, Homo sapiens
atggccaggcacctctggctga

SEQ ID NO: 10041186 - DNA, 22 bp, Homo sapiens
atggccgcctgtccttcccgcc

SEQ ID NO: 10041187 - DNA, 22 bp, Homo sapiens
cagcgtctcgttgtgggcctcg

SEQ ID NO: 10041188 - DNA, 22 bp, Homo sapiens
cagcaggataggtttctttgga

SEQ ID NO: 10041189 - DNA, 22 bp, Homo sapiens
agcctctgtagaaagcagtgtg

SEQ ID NO: 10041190 - DNA, 22 bp, Homo sapiens
agcctctggtcctccctcagct

SEQ ID NO: 10041191 - DNA, 22 bp, Homo sapiens
agcctctgctggccctggcact

SEQ ID NO: 10041192 - DNA, 22 bp, Homo sapiens
cagaaggagcgctaaggtccca

SEQ ID NO: 10041193 - DNA, 22 bp, Homo sapiens
agcataggcggtggtaggaccc

SEQ ID NO: 10041194 - DNA, 22 bp, Homo sapiens
agccactgtgagaggaccaggg

SEQ ID NO: 10041195 - DNA, 19 bp, Homo sapiens
agccagaactagtgtttct

SEQ ID NO: 10041196 - DNA, 22 bp, Homo sapiens
cagacatgatgtaagcagaggc

SEQ ID NO: 10041197 - DNA, 22 bp, Homo sapiens
cagacatgagatacagctgcta

SEQ ID NO: 10041198 - DNA, 22 bp, Homo sapiens
agcccagcaaaggggtttgaga

SEQ ID NO: 10041199 - DNA, 22 bp, Homo sapiens
agcccagcaaagggaggttcag

SEQ ID NO: 10041200 - DNA, 22 bp, Homo sapiens
agcccagcactgggggcccagc

SEQ ID NO: 10041201 - DNA, 22 bp, Homo sapiens
agcccagcagaaagtccagcct

SEQ ID NO: 10041202 - DNA, 22 bp, Homo sapiens
agcccagcccgggctgcgcttt

SEQ ID NO: 10041203 - DNA, 22 bp, Homo sapiens
agcccagccactattaaatgtt

SEQ ID NO: 10041204 - DNA, 22 bp, Homo sapiens
agcccagcagtaagattagaga

SEQ ID NO: 10041205 - DNA, 23 bp, Homo sapiens
agcccagcagagaacctaggtcc

SEQ ID NO: 10041206 - DNA, 22 bp, Homo sapiens
cagagggagtttctgaggttgc

SEQ ID NO: 10041207 - DNA, 22 bp, Homo sapiens
agcccagccggattcccagttc

SEQ ID NO: 10041208 - DNA, 21 bp, Homo sapiens
agcacagctttaagccatgtg

SEQ ID NO: 10041209 - DNA, 20 bp, Homo sapiens
caacactgcccattgtttgc

SEQ ID NO: 10041210 - DNA, 23 bp, Homo sapiens
caacactgccttcaggtgaagaa

SEQ ID NO: 10041211 - DNA, 22 bp, Homo sapiens
caaattaatgtgtctcaaaata

SEQ ID NO: 10041212 - DNA, 22 bp, Homo sapiens
caacagagggaatggatctcat

SEQ ID NO: 10041213 - DNA, 22 bp, Homo sapiens
caagcagaagcctcaggggcat

SEQ ID NO: 10041214 - DNA, 22 bp, Homo sapiens
caagcagaaatctagaactcca

SEQ ID NO: 10041215 - DNA, 22 bp, Homo sapiens
agcagcaggctgggatgagtct

SEQ ID NO: 10041216 - DNA, 22 bp, Homo sapiens
agcagcaggctgtgtggactga

SEQ ID NO: 10041217 - DNA, 22 bp, Homo sapiens
agcagcaggattttcgttggga

SEQ ID NO: 10041218 - DNA, 23 bp, Homo sapiens
agcagcaggaggtattgataagg

SEQ ID NO: 10041219 - DNA, 22 bp, Homo sapiens
agcagcaggctagggaactgct

SEQ ID NO: 10041220 - DNA, 22 bp, Homo sapiens
agcagcaggagccgtggggtga

SEQ ID NO: 10041221 - DNA, 22 bp, Homo sapiens
agcagcaggaggctgtccacca

SEQ ID NO: 10041222 - DNA, 22 bp, Homo sapiens
agcagcagctctgttgccctac

SEQ ID NO: 10041223 - DNA, 21 bp, Homo sapiens
agcagcagggaagcctcatcc

SEQ ID NO: 10041224 - DNA, 22 bp, Homo sapiens
agcagcagggcatgtcttactc

SEQ ID NO: 10041225 - DNA, 22 bp, Homo sapiens
agcagcagggctctgcccgtgc

SEQ ID NO: 10041226 - DNA, 22 bp, Homo sapiens
agcagcagggacaaaggaacag

SEQ ID NO: 10041227 - DNA, 22 bp, Homo sapiens
agcagcagggtcattgctcttt

SEQ ID NO: 10041228 - DNA, 22 bp, Homo sapiens
agcagcagggtgatagtgccca

SEQ ID NO: 10041229 - DNA, 22 bp, Homo sapiens
agcaggctccaggctggccatc

SEQ ID NO: 10041230 - DNA, 22 bp, Homo sapiens
agcagctgatggggaaggagtt

SEQ ID NO: 10041231 - DNA, 22 bp, Homo sapiens
cacacacagttttgtattctgt

SEQ ID NO: 10041232 - DNA, 22 bp, Homo sapiens
agcagggtgtggtggccctgga

SEQ ID NO: 10041233 - DNA, 22 bp, Homo sapiens
cacccaggctggagtgcagtga

SEQ ID NO: 10041234 - DNA, 22 bp, Homo sapiens
cacccaggctggagtgcagggg

SEQ ID NO: 10041235 - DNA, 22 bp, Homo sapiens
cacctctgcctcaagcttccca

SEQ ID NO: 10041236 - DNA, 22 bp, Homo sapiens
cacctctgctgtccacaggatg

SEQ ID NO: 10041237 - DNA, 22 bp, Homo sapiens
cacctctttgatttgaggcaag

SEQ ID NO: 10041238 - DNA, 22 bp, Homo sapiens
cacccaggctggagtgcagtgg

SEQ ID NO: 10041239 - DNA, 22 bp, Homo sapiens
cacccagggctgtgcctgccca

SEQ ID NO: 10041240 - DNA, 22 bp, Homo sapiens
cacccaggctggagtgcattgg

SEQ ID NO: 10041241 - DNA, 22 bp, Homo sapiens
atctaaaaggagctctttatct

SEQ ID NO: 10041242 - DNA, 23 bp, Homo sapiens
agaaaagttcatacctttttaac

SEQ ID NO: 10041243 - DNA, 23 bp, Homo sapiens
agaaaagttcatacctttttaac

SEQ ID NO: 10041244 - DNA, 22 bp, Homo sapiens
agaaaagtgctctagtgagagc

SEQ ID NO: 10041245 - DNA, 22 bp, Homo sapiens
ataaaatttgctactgttaaat

SEQ ID NO: 10041246 - DNA, 22 bp, Homo sapiens
atacagggacatccagtttttc

SEQ ID NO: 10041247 - DNA, 22 bp, Homo sapiens
atacagcagtgaataagataaa

SEQ ID NO: 10041248 - DNA, 22 bp, Homo sapiens
atacatgttgagaaaatatctg

SEQ ID NO: 10041249 - DNA, 22 bp, Homo sapiens
acgatgatgaaagagaacattc

SEQ ID NO: 10041250 - DNA, 22 bp, Homo sapiens
acgcccagactcccatactttg

SEQ ID NO: 10041251 - DNA, 22 bp, Homo sapiens
acctctgggaaaagtatggaaa

SEQ ID NO: 10041252 - DNA, 22 bp, Homo sapiens
acctctggccttcaggcatcat

SEQ ID NO: 10041253 - DNA, 19 bp, Homo sapiens
accctctccccactgggtc

SEQ ID NO: 10041254 - DNA, 19 bp, Homo sapiens
accctctctgtagaaagat

SEQ ID NO: 10041255 - DNA, 19 bp, Homo sapiens
accctctcagtgcctgagg

SEQ ID NO: 10041256 - DNA, 22 bp, Homo sapiens
acctgagacttgggatgggaat

SEQ ID NO: 10041257 - DNA, 22 bp, Homo sapiens
agtgttggagtcttggctgcag

SEQ ID NO: 10041258 - DNA, 23 bp, Homo sapiens
agtgttggttgggaagccaagca

SEQ ID NO: 10041259 - DNA, 22 bp, Homo sapiens
agtgttgggtctttagaattta

SEQ ID NO: 10041260 - DNA, 22 bp, Homo sapiens
agtgttggaccgaggtggagcc

SEQ ID NO: 10041261 - DNA, 22 bp, Homo sapiens
actgcacttcagcctgggtgac

SEQ ID NO: 10041262 - DNA, 22 bp, Homo sapiens
actgcacttcagcctgggtgtc

SEQ ID NO: 10041263 - DNA, 19 bp, Homo sapiens
actgcactttagcctgggc

SEQ ID NO: 10041264 - DNA, 22 bp, Homo sapiens
aggagcagaactgttgtggagg

SEQ ID NO: 10041265 - DNA, 22 bp, Homo sapiens
acagtcaatgagtgagtgaatg

SEQ ID NO: 10041266 - DNA, 22 bp, Homo sapiens
acagtcagggcttactcaggga

SEQ ID NO: 10041267 - DNA, 22 bp, Homo sapiens
acagtttgagaaccactagcct

SEQ ID NO: 10041268 - DNA, 22 bp, Homo sapiens
aggcactgggaatatgctgagg

SEQ ID NO: 10041269 - DNA, 22 bp, Homo sapiens
aggcactgggggatgagcaagg

SEQ ID NO: 10041270 - DNA, 22 bp, Homo sapiens
acagctgtatccccagagctca

SEQ ID NO: 10041271 - DNA, 22 bp, Homo sapiens
acaggcacaggtgtgccccacc

SEQ ID NO: 10041272 - DNA, 22 bp, Homo sapiens
acaggggcaggcaggacccttt

SEQ ID NO: 10041273 - DNA, 18 bp, Homo sapiens
acagggagggcgctgggg

SEQ ID NO: 10041274 - DNA, 22 bp, Homo sapiens
aggctgagaaagtgggaagatg

SEQ ID NO: 10041275 - DNA, 22 bp, Homo sapiens
aggcctctgggtctcctctgac

SEQ ID NO: 10041276 - DNA, 23 bp, Homo sapiens
acatcatgatagccaacttggga

SEQ ID NO: 10041277 - DNA, 22 bp, Homo sapiens
acatcagtcttttgcatacata

SEQ ID NO: 10041278 - DNA, 22 bp, Homo sapiens
acccagccatgttcagttctct

SEQ ID NO: 10041279 - DNA, 22 bp, Homo sapiens
acccagccacagcattgaggga

SEQ ID NO: 10041280 - DNA, 22 bp, Homo sapiens
acccagcctacaaagctcacct

SEQ ID NO: 10041281 - DNA, 22 bp, Homo sapiens
acccagcccagaatctggggcc

SEQ ID NO: 10041282 - DNA, 19 bp, Homo sapiens
acccagcccaggagtggca

SEQ ID NO: 10041283 - DNA, 17 bp, Homo sapiens
accagcctctcctgggg

SEQ ID NO: 10041284 - DNA, 22 bp, Homo sapiens
agggcagcaatttggttcctgg

SEQ ID NO: 10041285 - DNA, 22 bp, Homo sapiens
agggcagcagcggcccaggcct

SEQ ID NO: 10041286 - DNA, 22 bp, Homo sapiens
agggcagcaatgcagctgctgc

SEQ ID NO: 10041287 - DNA, 22 bp, Homo sapiens
accagcaggccaggggcactgc

SEQ ID NO: 10041288 - DNA, 22 bp, Homo sapiens
accagcaggtggcagtatgtat

SEQ ID NO: 10041289 - DNA, 22 bp, Homo sapiens
accagcagttatgaggccagga

SEQ ID NO: 10041290 - DNA, 22 bp, Homo sapiens
accagcagagttgaggaggaca

SEQ ID NO: 10041291 - DNA, 22 bp, Homo sapiens
accagcagcctagagcgttctt

SEQ ID NO: 10041292 - DNA, 22 bp, Homo sapiens
accagcagctgccagagtggag

SEQ ID NO: 10041293 - DNA, 21 bp, Homo sapiens
accagcaggagatcagaagga

SEQ ID NO: 10041294 - DNA, 22 bp, Homo sapiens
accagagctcttcagcacagga

SEQ ID NO: 10041295 - DNA, 22 bp, Homo sapiens
aggcttggttaattctgtgtga

SEQ ID NO: 10041296 - DNA, 22 bp, Homo sapiens
aggcttgggactgcttaggagc

SEQ ID NO: 10041297 - DNA, 22 bp, Homo sapiens
tcctcaaagttgtataaatatt

SEQ ID NO: 10041298 - DNA, 22 bp, Homo sapiens
tcctcaaatatttacttactga

SEQ ID NO: 10041299 - DNA, 22 bp, Homo sapiens
tcctcaggggtttcaggtgtac

SEQ ID NO: 10041300 - DNA, 22 bp, Homo sapiens
tccctggaggtgtttgctcagg

SEQ ID NO: 10041301 - DNA, 23 bp, Homo sapiens
tccctggaggcaggtccagggcc

SEQ ID NO: 10041302 - DNA, 22 bp, Homo sapiens
tccctggagataacttctggga

SEQ ID NO: 10041303 - DNA, 22 bp, Homo sapiens
tccctggagataacttctggga

SEQ ID NO: 10041304 - DNA, 22 bp, Homo sapiens
tccctggacaacagacttcact

SEQ ID NO: 10041305 - DNA, 22 bp, Homo sapiens
tccctggaacagagagacaacg

SEQ ID NO: 10041306 - DNA, 22 bp, Homo sapiens
tcccagggacccagcctgatac

SEQ ID NO: 10041307 - DNA, 22 bp, Homo sapiens
tcccagcctgacagtgcatcaa

SEQ ID NO: 10041308 - DNA, 22 bp, Homo sapiens
tcccagcctggaccctgccagt

SEQ ID NO: 10041309 - DNA, 22 bp, Homo sapiens
tcccagccttatctcccctggc

SEQ ID NO: 10041310 - DNA, 22 bp, Homo sapiens
tcccagccttccagtctggttt

SEQ ID NO: 10041311 - DNA, 22 bp, Homo sapiens
tcccagccttccttgtggtgaa

SEQ ID NO: 10041312 - DNA, 22 bp, Homo sapiens
tcccagcctttctttctccagc

SEQ ID NO: 10041313 - DNA, 22 bp, Homo sapiens
tcccagcctcctgacagttttg

SEQ ID NO: 10041314 - DNA, 22 bp, Homo sapiens
tcccagcccaggtatgatgata

SEQ ID NO: 10041315 - DNA, 22 bp, Homo sapiens
tcccagccggtgcctgggtccc

SEQ ID NO: 10041316 - DNA, 22 bp, Homo sapiens
tcctgagaggtttataacgcag

SEQ ID NO: 10041317 - DNA, 22 bp, Homo sapiens
tcctgagatgagacagtgctgc

SEQ ID NO: 10041318 - DNA, 22 bp, Homo sapiens
tcctcaggtgactaggtatctt

SEQ ID NO: 10041319 - DNA, 22 bp, Homo sapiens
tcctctggggcgtggtcctgga

SEQ ID NO: 10041320 - DNA, 22 bp, Homo sapiens
tcctctttctcaacattagtta

SEQ ID NO: 10041321 - DNA, 22 bp, Homo sapiens
tcagcatgttcttaggtcacag

SEQ ID NO: 10041322 - DNA, 20 bp, Homo sapiens
tcagcatgctcctcagacat

SEQ ID NO: 10041323 - DNA, 22 bp, Homo sapiens
tcagctgccccgggcactgccc

SEQ ID NO: 10041324 - DNA, 22 bp, Homo sapiens
tcagacagaaggactatttgaa

SEQ ID NO: 10041325 - DNA, 22 bp, Homo sapiens
tcaaccttgtgagaactgagtc

SEQ ID NO: 10041326 - DNA, 22 bp, Homo sapiens
tcactgcatcccatctccagcc

SEQ ID NO: 10041327 - DNA, 22 bp, Homo sapiens
tcactgcaacctccacctcccg

SEQ ID NO: 10041328 - DNA, 22 bp, Homo sapiens
tcagaaagcttagtgtcttgca

SEQ ID NO: 10041329 - DNA, 22 bp, Homo sapiens
tcagaaagctgattcttgatac

SEQ ID NO: 10041330 - DNA, 22 bp, Homo sapiens
tcagaaaggttctatgttttac

SEQ ID NO: 10041331 - DNA, 22 bp, Homo sapiens
tccaaattctatgttctttcca

SEQ ID NO: 10041332 - DNA, 22 bp, Homo sapiens
tccaaagaacattgctgagacc

SEQ ID NO: 10041333 - DNA, 22 bp, Homo sapiens
tcatgcaggtttccagccagat

SEQ ID NO: 10041334 - DNA, 22 bp, Homo sapiens
tcagggccggggctgtggcgag

SEQ ID NO: 10041335 - DNA, 22 bp, Homo sapiens
tcagggctgactgctactctcc

SEQ ID NO: 10041336 - DNA, 22 bp, Homo sapiens
tcaggagacttatgtcacagtg

SEQ ID NO: 10041337 - DNA, 22 bp, Homo sapiens
tatgaaatttaaacacagatca

SEQ ID NO: 10041338 - DNA, 22 bp, Homo sapiens
tatcagcaccgcggacagcatc

SEQ ID NO: 10041339 - DNA, 22 bp, Homo sapiens
tataaaatggcatcagctccaa

SEQ ID NO: 10041340 - DNA, 22 bp, Homo sapiens
tataaaattctcagtttggggt

SEQ ID NO: 10041341 - DNA, 22 bp, Homo sapiens
tatggaaaaatgtatcttgtca

SEQ ID NO: 10041342 - DNA, 22 bp, Homo sapiens
tatggaaactaattcatttttc

SEQ ID NO: 10041343 - DNA, 22 bp, Homo sapiens
tatggaaataattagacaagtg

SEQ ID NO: 10041344 - DNA, 18 bp, Homo sapiens
tatgtataacatagttca

SEQ ID NO: 10041345 - DNA, 22 bp, Homo sapiens
tatgtataatcacagagtgtca

SEQ ID NO: 10041346 - DNA, 22 bp, Homo sapiens
tatgtatatgtgtgttgacaac

SEQ ID NO: 10041347 - DNA, 22 bp, Homo sapiens
tatttttgcctctcagataaaa

SEQ ID NO: 10041348 - DNA, 22 bp, Homo sapiens
tattgtctcacagttttggagg

SEQ ID NO: 10041349 - DNA, 22 bp, Homo sapiens
tattgtctgcaaaggtttataa

SEQ ID NO: 10041350 - DNA, 22 bp, Homo sapiens
tagttgctaaaaagtgcctaac

SEQ ID NO: 10041351 - DNA, 22 bp, Homo sapiens
tagtgcaattccccatactaac

SEQ ID NO: 10041352 - DNA, 22 bp, Homo sapiens
taggcagattccatattttggc

SEQ ID NO: 10041353 - DNA, 22 bp, Homo sapiens
taaagcaaggaatagagtagtc

SEQ ID NO: 10041354 - DNA, 22 bp, Homo sapiens
taagagatgcttttctaaataa

SEQ ID NO: 10041355 - DNA, 22 bp, Homo sapiens
taagagattctaaagctactgg

SEQ ID NO: 10041356 - DNA, 22 bp, Homo sapiens
taaatgtgtgtagccatctgtg

SEQ ID NO: 10041357 - DNA, 22 bp, Homo sapiens
gttatataattcctgtggtagt

SEQ ID NO: 10041358 - DNA, 22 bp, Homo sapiens
gttatataagacaaatcagagt

SEQ ID NO: 10041359 - DNA, 22 bp, Homo sapiens
gttatatatagtatttctctga

SEQ ID NO: 10041360 - DNA, 22 bp, Homo sapiens
gtttcacagcaaagttccctgt

SEQ ID NO: 10041361 - DNA, 22 bp, Homo sapiens
gttcttttggtagagtgtgcat

SEQ ID NO: 10041362 - DNA, 19 bp, Homo sapiens
gttcttttcacctctgtgc

SEQ ID NO: 10041363 - DNA, 22 bp, Homo sapiens
gttgagagttaagcgggctaat

SEQ ID NO: 10041364 - DNA, 22 bp, Homo sapiens
tacagacagtttttcagatatt

SEQ ID NO: 10041365 - DNA, 22 bp, Homo sapiens
tacacaatgacttaagatgtca

SEQ ID NO: 10041366 - DNA, 22 bp, Homo sapiens
tacaacattgtgttgcttcata

SEQ ID NO: 10041367 - DNA, 22 bp, Homo sapiens
tacaacatttacgttaggctgt

SEQ ID NO: 10041368 - DNA, 22 bp, Homo sapiens
tacaacataacgggcattcagt

SEQ ID NO: 10041369 - DNA, 22 bp, Homo sapiens
tacaacatgtggtcctttatga

SEQ ID NO: 10041370 - DNA, 22 bp, Homo sapiens
tacaacattgtgttgcttcata

SEQ ID NO: 10041371 - DNA, 22 bp, Homo sapiens
tacaacatgtaaagtggtttaa

SEQ ID NO: 10041372 - DNA, 22 bp, Homo sapiens
tacacataggagggtaataaaa

SEQ ID NO: 10041373 - DNA, 22 bp, Homo sapiens
tacacataggtctgaataaaaa

SEQ ID NO: 10041374 - DNA, 23 bp, Homo sapiens
taatatcctgcaatgcacagaac

SEQ ID NO: 10041375 - DNA, 22 bp, Homo sapiens
ggcagctcacgggcatggggtg

SEQ ID NO: 10041376 - DNA, 22 bp, Homo sapiens
ggcagctcacctctggtccagg

SEQ ID NO: 10041377 - DNA, 17 bp, Homo sapiens
ggcagtggaggaagaga

SEQ ID NO: 10041378 - DNA, 22 bp, Homo sapiens
ggcaccaggctgggcataggcc

SEQ ID NO: 10041379 - DNA, 22 bp, Homo sapiens
ggcacctggatgtagcagtgaa

SEQ ID NO: 10041380 - DNA, 22 bp, Homo sapiens
ggcacctctgggctctgttagg

SEQ ID NO: 10041381 - DNA, 22 bp, Homo sapiens
ggcacctggtaagtgctcagta

SEQ ID NO: 10041382 - DNA, 22 bp, Homo sapiens
ggaggcacacctcagactggga

SEQ ID NO: 10041383 - DNA, 22 bp, Homo sapiens
ggaggaggggtttacattggaa

SEQ ID NO: 10041384 - DNA, 22 bp, Homo sapiens
ggcagcactgcagcttgttggg

SEQ ID NO: 10041385 - DNA, 22 bp, Homo sapiens
ggctctgcctgcccagcagcac

SEQ ID NO: 10041386 - DNA, 22 bp, Homo sapiens
ggctcagcaatgatgagcccct

SEQ ID NO: 10041387 - DNA, 22 bp, Homo sapiens
ggcccagctgtgcttccagccc

SEQ ID NO: 10041388 - DNA, 22 bp, Homo sapiens
ggcccagctttcattccttgct

SEQ ID NO: 10041389 - DNA, 22 bp, Homo sapiens
ggcccagctgtatattacagtt

SEQ ID NO: 10041390 - DNA, 22 bp, Homo sapiens
ggcccagctgggcggggacacg

SEQ ID NO: 10041391 - DNA, 22 bp, Homo sapiens
ggcccagtgtaccccaggcagt

SEQ ID NO: 10041392 - DNA, 20 bp, Homo sapiens
ggcccagtgaaccaggacgg

SEQ ID NO: 10041393 - DNA, 22 bp, Homo sapiens
ggcccagtgctgttcacccagt

SEQ ID NO: 10041394 - DNA, 22 bp, Homo sapiens
ggcccagcgaggccacctacag

SEQ ID NO: 10041395 - DNA, 22 bp, Homo sapiens
ggcccagctctattgaattaca

SEQ ID NO: 10041396 - DNA, 22 bp, Homo sapiens
ggcagtgggaaataagtgagaa

SEQ ID NO: 10041397 - DNA, 22 bp, Homo sapiens
ggccacagcagatgcttcagat

SEQ ID NO: 10041398 - DNA, 21 bp, Homo sapiens
ggccacagttagggctcagga

SEQ ID NO: 10041399 - DNA, 22 bp, Homo sapiens
ggctgcctcagatttgctgact

SEQ ID NO: 10041400 - DNA, 22 bp, Homo sapiens
ggctgcctcctcgagacaggat

SEQ ID NO: 10041401 - DNA, 22 bp, Homo sapiens
ggctgcctcctgctgggctgga

SEQ ID NO: 10041402 - DNA, 19 bp, Homo sapiens
ggctgcctcctgggagatt

SEQ ID NO: 10041403 - DNA, 22 bp, Homo sapiens
ggctgcctctatttaggatcaa

SEQ ID NO: 10041404 - DNA, 22 bp, Homo sapiens
ggctgcctgaactttggggaaa

SEQ ID NO: 10041405 - DNA, 22 bp, Homo sapiens
ggctgcctgaggctgaggcccg

SEQ ID NO: 10041406 - DNA, 22 bp, Homo sapiens
gggccctgatctgtgagcgcag

SEQ ID NO: 10041407 - DNA, 22 bp, Homo sapiens
gggccctctgcagctgcccagg

SEQ ID NO: 10041408 - DNA, 22 bp, Homo sapiens
gggccctggggatgtggacgcg

SEQ ID NO: 10041409 - DNA, 22 bp, Homo sapiens
gggccctgggattcagagcaag

SEQ ID NO: 10041410 - DNA, 22 bp, Homo sapiens
gggccctgcctaaggaacacac

SEQ ID NO: 10041411 - DNA, 22 bp, Homo sapiens
gggccctgccccgtggctctga

SEQ ID NO: 10041412 - DNA, 22 bp, Homo sapiens
gggccctgtgatttcttgagga

SEQ ID NO: 10041413 - DNA, 22 bp, Homo sapiens
gggccggagctgggtcccgcgc

SEQ ID NO: 10041414 - DNA, 22 bp, Homo sapiens
gggccctggggcctgatttgca

SEQ ID NO: 10041415 - DNA, 22 bp, Homo sapiens
gggcctcacctctccaccgcct

SEQ ID NO: 10041416 - DNA, 19 bp, Homo sapiens
gggcctcacccacacctcc

SEQ ID NO: 10041417 - DNA, 22 bp, Homo sapiens
gggctcactcatgcaactgcag

SEQ ID NO: 10041418 - DNA, 18 bp, Homo sapiens
gggctcacacaggtcatc

SEQ ID NO: 10041419 - DNA, 22 bp, Homo sapiens
gggccccactggggctgcctgc

SEQ ID NO: 10041420 - DNA, 22 bp, Homo sapiens
gggcccctgggaattctgtgat

SEQ ID NO: 10041421 - DNA, 22 bp, Homo sapiens
gggcccagtaccctctgccaag

SEQ ID NO: 10041422 - DNA, 22 bp, Homo sapiens
gggcccaggcctccttccttcc

SEQ ID NO: 10041423 - DNA, 22 bp, Homo sapiens
gggcaggtgtttccaaggtgag

SEQ ID NO: 10041424 - DNA, 22 bp, Homo sapiens
gggcaggtgttgtcaatctaat

SEQ ID NO: 10041425 - DNA, 22 bp, Homo sapiens
gggcaggtggcaaagccagagg

SEQ ID NO: 10041426 - DNA, 22 bp, Homo sapiens
gggcaggtggcagggtctctgg

SEQ ID NO: 10041427 - DNA, 22 bp, Homo sapiens
gggctcagaggagtggcctggg

SEQ ID NO: 10041428 - DNA, 21 bp, Homo sapiens
gggctcagcgctcggctcctc

SEQ ID NO: 10041429 - DNA, 22 bp, Homo sapiens
gggctcagctccttccttccta

SEQ ID NO: 10041430 - DNA, 22 bp, Homo sapiens
gggctcagttctgcttcatgct

SEQ ID NO: 10041431 - DNA, 22 bp, Homo sapiens
gggagtggattatgtggaccca

SEQ ID NO: 10041432 - DNA, 22 bp, Homo sapiens
gggagtggagagcaatggatga

SEQ ID NO: 10041433 - DNA, 22 bp, Homo sapiens
gggagtcaggctccctcagaga

SEQ ID NO: 10041434 - DNA, 22 bp, Homo sapiens
gggagtggttgatggtgaaaat

SEQ ID NO: 10041435 - DNA, 22 bp, Homo sapiens
gggagtgggtttggcctaggcc

SEQ ID NO: 10041436 - DNA, 22 bp, Homo sapiens
gggcactgtacactgtgcatgg

SEQ ID NO: 10041437 - DNA, 22 bp, Homo sapiens
gggcactgtgctaggtgctgag

SEQ ID NO: 10041438 - DNA, 20 bp, Homo sapiens
gggatcaggaaaggaggcta

SEQ ID NO: 10041439 - DNA, 22 bp, Homo sapiens
gggcaggtctgggtcagcctga

SEQ ID NO: 10041440 - DNA, 21 bp, Homo sapiens
gggcaggtctctgatgtcaac

SEQ ID NO: 10041441 - DNA, 23 bp, Homo sapiens
gtcctctggagagaaaggcagta

SEQ ID NO: 10041442 - DNA, 22 bp, Homo sapiens
gtccaggcacctcccttgtgct

SEQ ID NO: 10041443 - DNA, 22 bp, Homo sapiens
gtcctctgggctttgagcagtc

SEQ ID NO: 10041444 - DNA, 22 bp, Homo sapiens
gtcctctgtccctggggcacgg

SEQ ID NO: 10041445 - DNA, 22 bp, Homo sapiens
gtccagcccctgactcccaggc

SEQ ID NO: 10041446 - DNA, 22 bp, Homo sapiens
gtccagccctctgcctccaggt

SEQ ID NO: 10041447 - DNA, 22 bp, Homo sapiens
gtccagcccgggctccgccagc

SEQ ID NO: 10041448 - DNA, 22 bp, Homo sapiens
gtgcccagctccacctcacaga

SEQ ID NO: 10041449 - DNA, 22 bp, Homo sapiens
gtgccagaggccccaaacaagt

SEQ ID NO: 10041450 - DNA, 22 bp, Homo sapiens
gtgccagagattcctaaacttt

SEQ ID NO: 10041451 - DNA, 22 bp, Homo sapiens
gtgccagagacatgactagctg

SEQ ID NO: 10041452 - DNA, 22 bp, Homo sapiens
gtgaggagctgacactggggtg

SEQ ID NO: 10041453 - DNA, 22 bp, Homo sapiens
gtgagccaataccatgctgttc

SEQ ID NO: 10041454 - DNA, 22 bp, Homo sapiens
ggttagagggcatgcgatcttt

SEQ ID NO: 10041455 - DNA, 22 bp, Homo sapiens
ggtgacagccgcttggcgctag

SEQ ID NO: 10041456 - DNA, 22 bp, Homo sapiens
ggtgacagcgggtcaagaggag

SEQ ID NO: 10041457 - DNA, 22 bp, Homo sapiens
ggtgagcaaagcttcatctgta

SEQ ID NO: 10041458 - DNA, 22 bp, Homo sapiens
ggtcccagtcctctccctgcta

SEQ ID NO: 10041459 - DNA, 23 bp, Homo sapiens
ggtcccagtggagaggcctcacc

SEQ ID NO: 10041460 - DNA, 22 bp, Homo sapiens
ggtccccccatggtgagcactg

SEQ ID NO: 10041461 - DNA, 22 bp, Homo sapiens
ggtcccagctggtcactgtcag

SEQ ID NO: 10041462 - DNA, 22 bp, Homo sapiens
ggggaggaagctggaacacggg

SEQ ID NO: 10041463 - DNA, 22 bp, Homo sapiens
ggggtgggagtgccatccttga

SEQ ID NO: 10041464 - DNA, 22 bp, Homo sapiens
gccacccttatcccatgcttct

SEQ ID NO: 10041465 - DNA, 22 bp, Homo sapiens
gccaccctggacgcactgttcg

SEQ ID NO: 10041466 - DNA, 22 bp, Homo sapiens
gccaccctgagctgggccaggg

SEQ ID NO: 10041467 - DNA, 22 bp, Homo sapiens
gccaccctgacgccgcagaccc

SEQ ID NO: 10041468 - DNA, 18 bp, Homo sapiens
gccaccctcctcgtctcc

SEQ ID NO: 10041469 - DNA, 22 bp, Homo sapiens
gccaccctgcaaatgcccagga

SEQ ID NO: 10041470 - DNA, 22 bp, Homo sapiens
gccaccctggaccaccctgggc

SEQ ID NO: 10041471 - DNA, 20 bp, Homo sapiens
gcccaagcgccggccgcaga

SEQ ID NO: 10041472 - DNA, 22 bp, Homo sapiens
gcccaagccgccttccagagac

SEQ ID NO: 10041473 - DNA, 22 bp, Homo sapiens
gcccaagcagcttcccgagctt

SEQ ID NO: 10041474 - DNA, 22 bp, Homo sapiens
gccaggaaggctccctggtcac

SEQ ID NO: 10041475 - DNA, 22 bp, Homo sapiens
gcctccctccaccactgcaggt

SEQ ID NO: 10041476 - DNA, 22 bp, Homo sapiens
gcctccctgtagaggccagcct

SEQ ID NO: 10041477 - DNA, 18 bp, Homo sapiens
gcctccctggctacactt

SEQ ID NO: 10041478 - DNA, 22 bp, Homo sapiens
gcctggagacagcagaggcggc

SEQ ID NO: 10041479 - DNA, 22 bp, Homo sapiens
gcctggagaggaagccggtgga

SEQ ID NO: 10041480 - DNA, 16 bp, Homo sapiens
gcctggagtggcaggg

SEQ ID NO: 10041481 - DNA, 22 bp, Homo sapiens
gccctagcgccagctcagcacc

SEQ ID NO: 10041482 - DNA, 22 bp, Homo sapiens
gcccggccaggaacagagtata

SEQ ID NO: 10041483 - DNA, 22 bp, Homo sapiens
gcccctggctggccagctcctc

SEQ ID NO: 10041484 - DNA, 22 bp, Homo sapiens
gccccaggggaggtgccctgca

SEQ ID NO: 10041485 - DNA, 22 bp, Homo sapiens
gccccaggtggtaaacctaaga

SEQ ID NO: 10041486 - DNA, 22 bp, Homo sapiens
gccctggacagtgacggtgacc

SEQ ID NO: 10041487 - DNA, 22 bp, Homo sapiens
gccctggacagtgacggtgacc

SEQ ID NO: 10041488 - DNA, 22 bp, Homo sapiens
gccctggaatctctccatggga

SEQ ID NO: 10041489 - DNA, 22 bp, Homo sapiens
gccctggaatctctccatggga

SEQ ID NO: 10041490 - DNA, 22 bp, Homo sapiens
gcagctggttaatgggagaatt

SEQ ID NO: 10041491 - DNA, 23 bp, Homo sapiens
gcagctggttagaagggaaggag

SEQ ID NO: 10041492 - DNA, 22 bp, Homo sapiens
gcagctggctcagagaggtggg

SEQ ID NO: 10041493 - DNA, 22 bp, Homo sapiens
gcagctggctcagagaggtggg

SEQ ID NO: 10041494 - DNA, 22 bp, Homo sapiens
gcagcagattgttttttcacct

SEQ ID NO: 10041495 - DNA, 22 bp, Homo sapiens
gcagcagatgtgggcccagagc

SEQ ID NO: 10041496 - DNA, 22 bp, Homo sapiens
gcagcagaaggccaaggggagc

SEQ ID NO: 10041497 - DNA, 22 bp, Homo sapiens
gcagcagaagtagaagtacagg

SEQ ID NO: 10041498 - DNA, 22 bp, Homo sapiens
gcagcagcccagggctctcaga

SEQ ID NO: 10041499 - DNA, 22 bp, Homo sapiens
gcagccagcaggaagcgggaga

SEQ ID NO: 10041500 - DNA, 21 bp, Homo sapiens
gcagccagccgagaccatgcc

SEQ ID NO: 10041501 - DNA, 22 bp, Homo sapiens
gcaggtgatgtgatgtgagcat

SEQ ID NO: 10041502 - DNA, 22 bp, Homo sapiens
gcaggtgaatgatggactagga

SEQ ID NO: 10041503 - DNA, 22 bp, Homo sapiens
gcaggtagtgatcgagggtgac

SEQ ID NO: 10041504 - DNA, 19 bp, Homo sapiens
gcagggtggcagagctctt

SEQ ID NO: 10041505 - DNA, 22 bp, Homo sapiens
gcagggccaggtacaagaagca

SEQ ID NO: 10041506 - DNA, 22 bp, Homo sapiens
gcagggccagtgcagagaggaa

SEQ ID NO: 10041507 - DNA, 22 bp, Homo sapiens
gcagggccagggctcaggctgt

SEQ ID NO: 10041508 - DNA, 22 bp, Homo sapiens
gcagggccagggctcaggctgt

SEQ ID NO: 10041509 - DNA, 22 bp, Homo sapiens
gcagacagggctacagaggtac

SEQ ID NO: 10041510 - DNA, 19 bp, Homo sapiens
gcagagtcaagagctgctg

SEQ ID NO: 10041511 - DNA, 23 bp, Homo sapiens
gcagagtcaagtagtcatgagtg

SEQ ID NO: 10041512 - DNA, 22 bp, Homo sapiens
gcagagtcagcctccgagacag

SEQ ID NO: 10041513 - DNA, 22 bp, Homo sapiens
gcagagtctggtaggtgctggt

SEQ ID NO: 10041514 - DNA, 22 bp, Homo sapiens
gcagagtcccagcaggtggtgg

SEQ ID NO: 10041515 - DNA, 22 bp, Homo sapiens
gcagagtcaggattccatccca

SEQ ID NO: 10041516 - DNA, 22 bp, Homo sapiens
gcagagtcaggtccaaggactg

SEQ ID NO: 10041517 - DNA, 22 bp, Homo sapiens
gcagacagaagctaagtagaca

SEQ ID NO: 10041518 - DNA, 22 bp, Homo sapiens
gcagacacagggaaggcaagga

SEQ ID NO: 10041519 - DNA, 22 bp, Homo sapiens
gcagacacttcccactgcagcg

SEQ ID NO: 10041520 - DNA, 22 bp, Homo sapiens
gcacccagagggcagggtctcc

SEQ ID NO: 10041521 - DNA, 22 bp, Homo sapiens
gcacccagaggtcagcagtgct

SEQ ID NO: 10041522 - DNA, 22 bp, Homo sapiens
gcacccagcccagggcgtgatg

SEQ ID NO: 10041523 - DNA, 22 bp, Homo sapiens
gcacagagagcagtgggggaca

SEQ ID NO: 10041524 - DNA, 22 bp, Homo sapiens
gcaataaataacatggaagaca

SEQ ID NO: 10041525 - DNA, 22 bp, Homo sapiens
gcaaggaggctggtggaggaag

SEQ ID NO: 10041526 - DNA, 22 bp, Homo sapiens
gcaaggagcctggaggtgagtg

SEQ ID NO: 10041527 - DNA, 22 bp, Homo sapiens
gcaaggagcacctttctggaac

SEQ ID NO: 10041528 - DNA, 22 bp, Homo sapiens
ggagaagcagcttcttgatgaa

SEQ ID NO: 10041529 - DNA, 22 bp, Homo sapiens
ggagcctggcaatgctgcgtcc

SEQ ID NO: 10041530 - DNA, 22 bp, Homo sapiens
ggagccatgttttcagcatgat

SEQ ID NO: 10041531 - DNA, 22 bp, Homo sapiens
ggaggaggggcgctttgtctat

SEQ ID NO: 10041532 - DNA, 22 bp, Homo sapiens
ggaggaggggtgactgaatgct

SEQ ID NO: 10041533 - DNA, 22 bp, Homo sapiens
ggagctggctacagagaactcc

SEQ ID NO: 10041534 - DNA, 22 bp, Homo sapiens
ggacaggcccggggagcctgga

SEQ ID NO: 10041535 - DNA, 22 bp, Homo sapiens
ggacagagggttgacagagtat

SEQ ID NO: 10041536 - DNA, 22 bp, Homo sapiens
ggacaggagtgaggcgggttcc

SEQ ID NO: 10041537 - DNA, 22 bp, Homo sapiens
gcttaaaagccacttagtctat

SEQ ID NO: 10041538 - DNA, 22 bp, Homo sapiens
gctggccaggaagagtctcaga

SEQ ID NO: 10041539 - DNA, 22 bp, Homo sapiens
gctggccaaagtgtacctggag

SEQ ID NO: 10041540 - DNA, 22 bp, Homo sapiens
gctggccacactgctgatggag

SEQ ID NO: 10041541 - DNA, 22 bp, Homo sapiens
gctgtcacaaatatttctcagc

SEQ ID NO: 10041542 - DNA, 22 bp, Homo sapiens
gctgtcacacatgggatctcag

SEQ ID NO: 10041543 - DNA, 22 bp, Homo sapiens
gctgcctctgtagctttggacc

SEQ ID NO: 10041544 - DNA, 22 bp, Homo sapiens
gctggaggtagggaggtcctgt

SEQ ID NO: 10041545 - DNA, 22 bp, Homo sapiens
gctggaggtttcacctgagttt

SEQ ID NO: 10041546 - DNA, 22 bp, Homo sapiens
gctgcaggctctgcaggaattg

SEQ ID NO: 10041547 - DNA, 22 bp, Homo sapiens
gctgcctcctgagatttgggca

SEQ ID NO: 10041548 - DNA, 22 bp, Homo sapiens
gctgcctccactggctcccagt

SEQ ID NO: 10041549 - DNA, 22 bp, Homo sapiens
gctgcctcccccatggctggaa

SEQ ID NO: 10041550 - DNA, 23 bp, Homo sapiens
gctgcctcctacaaaagcccagc

SEQ ID NO: 10041551 - DNA, 22 bp, Homo sapiens
gctgcctccgccggctccacag

SEQ ID NO: 10041552 - DNA, 22 bp, Homo sapiens
gctcagggagtttcacagtgta

SEQ ID NO: 10041553 - DNA, 22 bp, Homo sapiens
gctaggttggggaagttctcct

SEQ ID NO: 10041554 - DNA, 22 bp, Homo sapiens
gctagcctgcagtggctatggt

SEQ ID NO: 10041555 - DNA, 19 bp, Homo sapiens
gctctccctctcagttgag

SEQ ID NO: 10041556 - DNA, 22 bp, Homo sapiens
gaggtggctgcttgctgggaaa

SEQ ID NO: 10041557 - DNA, 22 bp, Homo sapiens
gagggtccctgctcagggccag

SEQ ID NO: 10041558 - DNA, 22 bp, Homo sapiens
gagggaagaggcctgacatttt

SEQ ID NO: 10041559 - DNA, 22 bp, Homo sapiens
gaggcgagaagctggagatggt

SEQ ID NO: 10041560 - DNA, 22 bp, Homo sapiens
gaggcggcggccgagcctggct

SEQ ID NO: 10041561 - DNA, 22 bp, Homo sapiens
gagcaggcctggggtgaggcct

SEQ ID NO: 10041562 - DNA, 22 bp, Homo sapiens
gagcaggatgggagctggggcc

SEQ ID NO: 10041563 - DNA, 22 bp, Homo sapiens
gagctccagggaacagcagcta

SEQ ID NO: 10041564 - DNA, 22 bp, Homo sapiens
gaggagtgccagccgtggagtc

SEQ ID NO: 10041565 - DNA, 22 bp, Homo sapiens
gacctggaagaactgaggcctt

SEQ ID NO: 10041566 - DNA, 18 bp, Homo sapiens
gacaaaagtacagacaga

SEQ ID NO: 10041567 - DNA, 22 bp, Homo sapiens
gagaagaacttgggcaaagtca

SEQ ID NO: 10041568 - DNA, 22 bp, Homo sapiens
gagagcaggaggcagcgggacg

SEQ ID NO: 10041569 - DNA, 22 bp, Homo sapiens
gagagcatgtggtctagtttta

SEQ ID NO: 10041570 - DNA, 22 bp, Homo sapiens
gagaggagacttatccagattg

SEQ ID NO: 10041571 - DNA, 22 bp, Homo sapiens
gagaggagtaggctgatggtgc

SEQ ID NO: 10041572 - DNA, 22 bp, Homo sapiens
gagcaaggagggtggggccttt

SEQ ID NO: 10041573 - DNA, 22 bp, Homo sapiens
gagcaaggatgggtctatagta

SEQ ID NO: 10041574 - DNA, 22 bp, Homo sapiens
gagcaaggatggccggggccgt

SEQ ID NO: 10041575 - DNA, 22 bp, Homo sapiens
gagcaaggcggcatctctctga

SEQ ID NO: 10041576 - DNA, 22 bp, Homo sapiens
gagcaaggtagctctctggggc

SEQ ID NO: 10041577 - DNA, 22 bp, Homo sapiens
gagcagaacaggccgggtggga

SEQ ID NO: 10041578 - DNA, 22 bp, Homo sapiens
gagcagaactactcacatatcg

SEQ ID NO: 10041579 - DNA, 22 bp, Homo sapiens
gagcagaaagttatgtcttgca

SEQ ID NO: 10041580 - DNA, 22 bp, Homo sapiens
gagcagagcttctcaaagtaaa

SEQ ID NO: 10041581 - DNA, 22 bp, Homo sapiens
gagcaggaaggccagaagggtc

SEQ ID NO: 10041582 - DNA, 23 bp, Homo sapiens
ctttcctttctttgacacccagc

SEQ ID NO: 10041583 - DNA, 22 bp, Homo sapiens
ctttccttaataagcaggtata

SEQ ID NO: 10041584 - DNA, 22 bp, Homo sapiens
ctttccttctcgtggttctcac

SEQ ID NO: 10041585 - DNA, 22 bp, Homo sapiens
cttgcttggagaagagatcagt

SEQ ID NO: 10041586 - DNA, 22 bp, Homo sapiens
cttgcttgattatgatcataaa

SEQ ID NO: 10041587 - DNA, 22 bp, Homo sapiens
cttgcttgaggtatggaatggg

SEQ ID NO: 10041588 - DNA, 21 bp, Homo sapiens
cttccccaggctggtctgtat

SEQ ID NO: 10041589 - DNA, 22 bp, Homo sapiens
cttctgtagccagtaacatata

SEQ ID NO: 10041590 - DNA, 22 bp, Homo sapiens
gaaattaagcaggggtctgtgg

SEQ ID NO: 10041591 - DNA, 22 bp, Homo sapiens
gaaattaaccacctttggcttt

SEQ ID NO: 10041592 - DNA, 22 bp, Homo sapiens
gaaagagaacctgggcctagat

SEQ ID NO: 10041593 - DNA, 22 bp, Homo sapiens
ctttggaggtcatagccaagag

SEQ ID NO: 10041594 - DNA, 22 bp, Homo sapiens
gaaacttgcctgaagtcaacca

SEQ ID NO: 10041595 - DNA, 22 bp, Homo sapiens
gaaactctcgcatcctgggaac

SEQ ID NO: 10041596 - DNA, 22 bp, Homo sapiens
ctggggtggtgcaggcctcatg

SEQ ID NO: 10041597 - DNA, 22 bp, Homo sapiens
ctgggctcctaaccatccaggt

SEQ ID NO: 10041598 - DNA, 22 bp, Homo sapiens
ctgggatgctccggcctggatg

SEQ ID NO: 10041599 - DNA, 22 bp, Homo sapiens
ctgggatggctccgctgctgct

SEQ ID NO: 10041600 - DNA, 22 bp, Homo sapiens
ctgggccagcaactgcaatgga

SEQ ID NO: 10041601 - DNA, 22 bp, Homo sapiens
ctgggcccacgagggctctggg

SEQ ID NO: 10041602 - DNA, 22 bp, Homo sapiens
ctgtggcaggtgtctggggcag

SEQ ID NO: 10041603 - DNA, 22 bp, Homo sapiens
ttctggattttccaactcactg

SEQ ID NO: 10041604 - DNA, 22 bp, Homo sapiens
ttctggatgttgtagtctgaga

SEQ ID NO: 10041605 - DNA, 22 bp, Homo sapiens
cgttcctctactccagctaccc

SEQ ID NO: 10041606 - DNA, 22 bp, Homo sapiens
ttctggatgatccatttacaga

SEQ ID NO: 10041607 - DNA, 22 bp, Homo sapiens
ttctgcagtgaatgactcaata

SEQ ID NO: 10041608 - DNA, 22 bp, Homo sapiens
ttggaaaagtgaaactagatgc

SEQ ID NO: 10041609 - DNA, 22 bp, Homo sapiens
ttggaaggagtctttggggatg

SEQ ID NO: 10041610 - DNA, 22 bp, Homo sapiens
ttggaagggatattggcatatg

SEQ ID NO: 10041611 - DNA, 22 bp, Homo sapiens
ttggaaggtgagtccctgggtt

SEQ ID NO: 10041612 - DNA, 22 bp, Homo sapiens
ttggaaggttctggtcatggtt

SEQ ID NO: 10041613 - DNA, 22 bp, Homo sapiens
ttgccctgcagcggtgagtggt

SEQ ID NO: 10041614 - DNA, 22 bp, Homo sapiens
ttgccctgcctccctgaggtga

SEQ ID NO: 10041615 - DNA, 22 bp, Homo sapiens
ccttcaaactttcattaaccag

SEQ ID NO: 10041616 - DNA, 22 bp, Homo sapiens
ccttcaaaacactagtttttga

SEQ ID NO: 10041617 - DNA, 22 bp, Homo sapiens
ccttcaaattctcttagctgaa

SEQ ID NO: 10041618 - DNA, 23 bp, Homo sapiens
ttataaatattttcaggtgtgtt

SEQ ID NO: 10041619 - DNA, 22 bp, Homo sapiens
ttaagatttgtagagaaaaagc

SEQ ID NO: 10041620 - DNA, 22 bp, Homo sapiens
ttaaattattgagggattgtca

SEQ ID NO: 10041621 - DNA, 22 bp, Homo sapiens
ttaaattatttctagtgaggtg

SEQ ID NO: 10041622 - DNA, 22 bp, Homo sapiens
ttaaattagtcaagcttctctg

SEQ ID NO: 10041623 - DNA, 22 bp, Homo sapiens
ccttaagtacctgactagcatg

SEQ ID NO: 10041624 - DNA, 22 bp, Homo sapiens
ccttaaaagaactatctcttct

SEQ ID NO: 10041625 - DNA, 22 bp, Homo sapiens
cgaagtttggggagaggagtct

SEQ ID NO: 10041626 - DNA, 21 bp, Homo sapiens
cgaagtttgggcagaggggtc

SEQ ID NO: 10041627 - DNA, 22 bp, Homo sapiens
ccttttgctctcccatccagaa

SEQ ID NO: 10041628 - DNA, 22 bp, Homo sapiens
ttcaaattaccacatttgctta

SEQ ID NO: 10041629 - DNA, 22 bp, Homo sapiens
ctctgcacacaagtaatttcat

SEQ ID NO: 10041630 - DNA, 22 bp, Homo sapiens
ctctgcacccccggctcctcgt

SEQ ID NO: 10041631 - DNA, 23 bp, Homo sapiens
ctctgcaccaggtggttttcagc

SEQ ID NO: 10041632 - DNA, 22 bp, Homo sapiens
ctctgcactgtccggctttctt

SEQ ID NO: 10041633 - DNA, 22 bp, Homo sapiens
ctctgcaccttgtaggaggcaa

SEQ ID NO: 10041634 - DNA, 22 bp, Homo sapiens
ctctgcacctacacaacaggaa

SEQ ID NO: 10041635 - DNA, 22 bp, Homo sapiens
ttttgcctgcactgtatatata

SEQ ID NO: 10041636 - DNA, 22 bp, Homo sapiens
ctctgaaagacaagctctcatt

SEQ ID NO: 10041637 - DNA, 22 bp, Homo sapiens
ctgcaggatttcatgggctgac

SEQ ID NO: 10041638 - DNA, 22 bp, Homo sapiens
ctcttccttaagactataaaga

SEQ ID NO: 10041639 - DNA, 22 bp, Homo sapiens
ctggaaggagaaggaggctgtg

SEQ ID NO: 10041640 - DNA, 22 bp, Homo sapiens
ctggaaggagaaggaggctgtg

SEQ ID NO: 10041641 - DNA, 22 bp, Homo sapiens
ctggaaggagcccgggcggatc

SEQ ID NO: 10041642 - DNA, 22 bp, Homo sapiens
ctggaaggtggatggcgaggcc

SEQ ID NO: 10041643 - DNA, 22 bp, Homo sapiens
ctggagataagcagtcccaggc

SEQ ID NO: 10041644 - DNA, 22 bp, Homo sapiens
ccagggccaagagacctcgagg

SEQ ID NO: 10041645 - DNA, 22 bp, Homo sapiens
ccagggcccacggccagaatag

SEQ ID NO: 10041646 - DNA, 22 bp, Homo sapiens
tgagaaaaggttgagatgataa

SEQ ID NO: 10041647 - DNA, 22 bp, Homo sapiens
tgagcagactctgcagagccac

SEQ ID NO: 10041648 - DNA, 22 bp, Homo sapiens
tgagataactctgatttatgtt

SEQ ID NO: 10041649 - DNA, 21 bp, Homo sapiens
tgagataaatttccttactac

SEQ ID NO: 10041650 - DNA, 22 bp, Homo sapiens
tgagataacaaaattatcttca

SEQ ID NO: 10041651 - DNA, 22 bp, Homo sapiens
tgagataataaatagctttctt

SEQ ID NO: 10041652 - DNA, 22 bp, Homo sapiens
tgagataaggatgttatactcg

SEQ ID NO: 10041653 - DNA, 22 bp, Homo sapiens
tgaaagggaacctgctggactg

SEQ ID NO: 10041654 - DNA, 22 bp, Homo sapiens
ccaggctcaggcctgctcgttg

SEQ ID NO: 10041655 - DNA, 22 bp, Homo sapiens
tctgcagagcattatagcaaaa

SEQ ID NO: 10041656 - DNA, 22 bp, Homo sapiens
tctgcagaattgtctcaagcta

SEQ ID NO: 10041657 - DNA, 22 bp, Homo sapiens
tgcagcagtcagtcaggcctgg

SEQ ID NO: 10041658 - DNA, 22 bp, Homo sapiens
tgcagcaggtgacaacgagtgg

SEQ ID NO: 10041659 - DNA, 22 bp, Homo sapiens
tgcagcaggtatggcaagctcc

SEQ ID NO: 10041660 - DNA, 22 bp, Homo sapiens
cccacaggtggaagcctcggaa

SEQ ID NO: 10041661 - DNA, 22 bp, Homo sapiens
cccacaggcaggtgcatgggct

SEQ ID NO: 10041662 - DNA, 22 bp, Homo sapiens
tgcagaggtgaaagactagcaa

SEQ ID NO: 10041663 - DNA, 22 bp, Homo sapiens
cccaggaggcctgcctggccgg

SEQ ID NO: 10041664 - DNA, 18 bp, Homo sapiens
tgcatatactgcctatct

SEQ ID NO: 10041665 - DNA, 19 bp, Homo sapiens
tgcatatatctatgaaaga

SEQ ID NO: 10041666 - DNA, 22 bp, Homo sapiens
cccaggagcttctctctgcctc

SEQ ID NO: 10041667 - DNA, 19 bp, Homo sapiens
cccaggagtctggctggtt

SEQ ID NO: 10041668 - DNA, 22 bp, Homo sapiens
tgcccagcttcttacttttaaa

SEQ ID NO: 10041669 - DNA, 22 bp, Homo sapiens
tgcaggtggacacgggagacgg

SEQ ID NO: 10041670 - DNA, 22 bp, Homo sapiens
cccagctccagagccagaaaca

SEQ ID NO: 10041671 - DNA, 22 bp, Homo sapiens
cccagctcccatgttctccaat

SEQ ID NO: 10041672 - DNA, 22 bp, Homo sapiens
cccaggacccttcaatggctcc

SEQ ID NO: 10041673 - DNA, 17 bp, Homo sapiens
tgcagcagttcccatct

SEQ ID NO: 10041674 - DNA, 22 bp, Homo sapiens
tgcagcagtttaatgcagggtt

SEQ ID NO: 10041675 - DNA, 22 bp, Homo sapiens
cctcacagagcccagatgtcta

SEQ ID NO: 10041676 - DNA, 22 bp, Homo sapiens
cctatttgtaggctgggccagt

SEQ ID NO: 10041677 - DNA, 22 bp, Homo sapiens
cctcacagaggggcagccatct

SEQ ID NO: 10041678 - DNA, 22 bp, Homo sapiens
ccgtctgcagcctccaggagtt

SEQ ID NO: 10041679 - DNA, 22 bp, Homo sapiens
ccctgggatggattggcaggaa

SEQ ID NO: 10041680 - DNA, 22 bp, Homo sapiens
ccctggagctgcttgcatgttg

SEQ ID NO: 10041681 - DNA, 22 bp, Homo sapiens
cctcagccttggccccaggcag

SEQ ID NO: 10041682 - DNA, 22 bp, Homo sapiens
cctcagctgcttccctggagcc

SEQ ID NO: 10041683 - DNA, 22 bp, Homo sapiens
tggccctgcttatgtctctctt

SEQ ID NO: 10041684 - DNA, 22 bp, Homo sapiens
tggcctcaatctgtcctccagc

SEQ ID NO: 10041685 - DNA, 22 bp, Homo sapiens
tggctcagcgcggcctggtctt

SEQ ID NO: 10041686 - DNA, 22 bp, Homo sapiens
tggctcagcggtggcagcagac

SEQ ID NO: 10041687 - DNA, 22 bp, Homo sapiens
tggacagttactgagcttgagt

SEQ ID NO: 10041688 - DNA, 22 bp, Homo sapiens
tggacaggttgagtaggaggag

SEQ ID NO: 10041689 - DNA, 23 bp, Homo sapiens
ccctgcactaagaggagaaggtg

SEQ ID NO: 10041690 - DNA, 23 bp, Homo sapiens
ccctggagctagtctgagcagag

SEQ ID NO: 10041691 - DNA, 18 bp, Homo sapiens
tgcctgccccgtaagggt

SEQ ID NO: 10041692 - DNA, 22 bp, Homo sapiens
tgggccagagagtaagaaaggt

SEQ ID NO: 10041693 - DNA, 22 bp, Homo sapiens
cctctggcctaggccgggagag

SEQ ID NO: 10041694 - DNA, 22 bp, Homo sapiens
cctcttgccaatcagctacaga

SEQ ID NO: 10041695 - DNA, 22 bp, Homo sapiens
tggctctcagctcccagcagcc

SEQ ID NO: 10041696 - DNA, 23 bp, Homo sapiens
tggctctctcagtgctgcagagg

SEQ ID NO: 10041697 - DNA, 22 bp, Homo sapiens
cctgctgctatgaaggtgacag

SEQ ID NO: 10041698 - DNA, 22 bp, Homo sapiens
tgtacatacatagatatacaca

SEQ ID NO: 10041699 - DNA, 18 bp, Homo sapiens
cctggagctccacagcaa

SEQ ID NO: 10041700 - DNA, 22 bp, Homo sapiens
cctggaggcggaggttgcagtg

SEQ ID NO: 10041701 - DNA, 22 bp, Homo sapiens
tctctgcatccccagggctctc

SEQ ID NO: 10041702 - DNA, 22 bp, Homo sapiens
ccagcagctccctcagggtccg

SEQ ID NO: 10041703 - DNA, 22 bp, Homo sapiens
ccagcagagttggtttctggta

SEQ ID NO: 10041704 - DNA, 22 bp, Homo sapiens
ccagcagcagcgtccaaggaga

SEQ ID NO: 10041705 - DNA, 22 bp, Homo sapiens
ccagcagagtggggtttagagt

SEQ ID NO: 10041706 - DNA, 22 bp, Homo sapiens
ccagcagagtctaggaaggagg

SEQ ID NO: 10041707 - DNA, 22 bp, Homo sapiens
ccagcagagggtcttggccatt

SEQ ID NO: 10041708 - DNA, 22 bp, Homo sapiens
ccagcagagtatcaatgtattt

SEQ ID NO: 10041709 - DNA, 22 bp, Homo sapiens
ccagcagaggggcggagtgcag

SEQ ID NO: 10041710 - DNA, 22 bp, Homo sapiens
ccagccctgcctctcagggccc

SEQ ID NO: 10041711 - DNA, 22 bp, Homo sapiens
ccagccctcactgaggcctctc

SEQ ID NO: 10041712 - DNA, 19 bp, Homo sapiens
tctgcagaaggcatacatg

SEQ ID NO: 10041713 - DNA, 21 bp, Homo sapiens
tcctctgcagtgaggtggcct

SEQ ID NO: 10041714 - DNA, 22 bp, Homo sapiens
tctcccacagtctcccatggct

SEQ ID NO: 10041715 - DNA, 23 bp, Homo sapiens
tctccctgaggttgttagcatta

SEQ ID NO: 10041716 - DNA, 20 bp, Homo sapiens
tctccctgcccatctcagat

SEQ ID NO: 10041717 - DNA, 22 bp, Homo sapiens
tcatgcactacataacgatgtt

SEQ ID NO: 10041718 - DNA, 17 bp, Homo sapiens
tccagcctcctctgctg

SEQ ID NO: 10041719 - DNA, 22 bp, Homo sapiens
tccccactcaccactggccaaa

SEQ ID NO: 10041720 - DNA, 22 bp, Homo sapiens
tcccagggtcagtggtgaggcc

SEQ ID NO: 10041721 - DNA, 22 bp, Homo sapiens
tccccactgggcctcctctttc

SEQ ID NO: 10041722 - DNA, 22 bp, Homo sapiens
tcctctccatattttctgattt

SEQ ID NO: 10041723 - DNA, 22 bp, Homo sapiens
tcccagccaggctctaccactt

SEQ ID NO: 10041724 - DNA, 22 bp, Homo sapiens
tcccagccacagtttccacctg

SEQ ID NO: 10041725 - DNA, 22 bp, Homo sapiens
tcccagcccagacttctccagt

SEQ ID NO: 10041726 - DNA, 22 bp, Homo sapiens
tcccagccattcctttaggtgt

SEQ ID NO: 10041727 - DNA, 22 bp, Homo sapiens
tcccagcccagatttgtgtgac

SEQ ID NO: 10041728 - DNA, 22 bp, Homo sapiens
tcccagccacaggtgtagccct

SEQ ID NO: 10041729 - DNA, 22 bp, Homo sapiens
catgttggtgtgctgcacccgt

SEQ ID NO: 10041730 - DNA, 22 bp, Homo sapiens
catgttggtgtgctgcacccat

SEQ ID NO: 10041731 - DNA, 22 bp, Homo sapiens
catgttggcactgtctctgcct

SEQ ID NO: 10041732 - DNA, 22 bp, Homo sapiens
taggacccctgtggtagatggg

SEQ ID NO: 10041733 - DNA, 22 bp, Homo sapiens
cagggccttcgtaagtgtccgg

SEQ ID NO: 10041734 - DNA, 22 bp, Homo sapiens
taggtagctttggcgtttcttg

SEQ ID NO: 10041735 - DNA, 22 bp, Homo sapiens
tatcattctaattctcctcgta

SEQ ID NO: 10041736 - DNA, 22 bp, Homo sapiens
cagggtggcactcagcgcatct

SEQ ID NO: 10041737 - DNA, 22 bp, Homo sapiens
cagggtggcaggcaccatggcc

SEQ ID NO: 10041738 - DNA, 22 bp, Homo sapiens
cagggtggccaggtagataata

SEQ ID NO: 10041739 - DNA, 22 bp, Homo sapiens
tagcaaggacgtccaaagaact

SEQ ID NO: 10041740 - DNA, 22 bp, Homo sapiens
tagcaaggacaacatatgagag

SEQ ID NO: 10041741 - DNA, 22 bp, Homo sapiens
tagcaaggcgtggcactcaaat

SEQ ID NO: 10041742 - DNA, 22 bp, Homo sapiens
tagcaaggcttccaatgaacag

SEQ ID NO: 10041743 - DNA, 22 bp, Homo sapiens
tagcaaggtgaagtatgggtga

SEQ ID NO: 10041744 - DNA, 22 bp, Homo sapiens
cagtgccatgtctgagccccta

SEQ ID NO: 10041745 - DNA, 21 bp, Homo sapiens
cagtggcagttcttgcctctg

SEQ ID NO: 10041746 - DNA, 22 bp, Homo sapiens
cagtggcagttagaaaatattc

SEQ ID NO: 10041747 - DNA, 22 bp, Homo sapiens
cagtgggggtgaggccgaggta

SEQ ID NO: 10041748 - DNA, 22 bp, Homo sapiens
cagtggggaggccaggatagaa

SEQ ID NO: 10041749 - DNA, 22 bp, Homo sapiens
tcagcagaagtatagaggccat

SEQ ID NO: 10041750 - DNA, 21 bp, Homo sapiens
tcagcagaatatgaactgcac

SEQ ID NO: 10041751 - DNA, 19 bp, Homo sapiens
tcagcagattttgcaaaca

SEQ ID NO: 10041752 - DNA, 21 bp, Homo sapiens
tcagcagcatctgcctagagt

SEQ ID NO: 10041753 - DNA, 22 bp, Homo sapiens
tcagcagatgtggtgaaaagtc

SEQ ID NO: 10041754 - DNA, 22 bp, Homo sapiens
tcagcagatgatttccatacaa

SEQ ID NO: 10041755 - DNA, 22 bp, Homo sapiens
tcagcagatgggttgtgttggc

SEQ ID NO: 10041756 - DNA, 22 bp, Homo sapiens
tcagcagagtttcatcttggga

SEQ ID NO: 10041757 - DNA, 22 bp, Homo sapiens
tcagcagaggagtgtcttgccc

SEQ ID NO: 10041758 - DNA, 22 bp, Homo sapiens
tcagcagagtggaacattgtca

SEQ ID NO: 10041759 - DNA, 22 bp, Homo sapiens
tcagcagaggcagactctcctt

SEQ ID NO: 10041760 - DNA, 22 bp, Homo sapiens
tcagcagaggggaaggcatctg

SEQ ID NO: 10041761 - DNA, 22 bp, Homo sapiens
tcagcagactaggcagattact

SEQ ID NO: 10041762 - DNA, 22 bp, Homo sapiens
tcagcagagcgagaccaagtca

SEQ ID NO: 10041763 - DNA, 22 bp, Homo sapiens
tcagcagagctcaggctccagc

SEQ ID NO: 10041764 - DNA, 22 bp, Homo sapiens
tcagcagaatcttcctacacct

SEQ ID NO: 10041765 - DNA, 22 bp, Homo sapiens
tcagcagaatgtggcatgtcac

SEQ ID NO: 10041766 - DNA, 22 bp, Homo sapiens
tcagcagacagttagctatatt

SEQ ID NO: 10041767 - DNA, 22 bp, Homo sapiens
tcagcagacattattttctggc

SEQ ID NO: 10041768 - DNA, 22 bp, Homo sapiens
tcagcagacctgttatttggat

SEQ ID NO: 10041769 - DNA, 22 bp, Homo sapiens
cagggtgggcacccagcctcca

SEQ ID NO: 10041770 - DNA, 22 bp, Homo sapiens
cagggtggccctgtggtctcat

SEQ ID NO: 10041771 - DNA, 22 bp, Homo sapiens
caggttccagttgcagggactt

SEQ ID NO: 10041772 - DNA, 22 bp, Homo sapiens
caggttcccaggtccagggctt

SEQ ID NO: 10041773 - DNA, 22 bp, Homo sapiens
caggttccctagcagcaaagcc

SEQ ID NO: 10041774 - DNA, 22 bp, Homo sapiens
caggttcccttgcagctaagtg

SEQ ID NO: 10041775 - DNA, 22 bp, Homo sapiens
cagtagcatgtaataaagacag

SEQ ID NO: 10041776 - DNA, 22 bp, Homo sapiens
tcacaacaggaaggaccagctg

SEQ ID NO: 10041777 - DNA, 22 bp, Homo sapiens
tttgtgtggatggaaggcagta

SEQ ID NO: 10041778 - DNA, 22 bp, Homo sapiens
tttgtgtggcgttggccggcgg

SEQ ID NO: 10041779 - DNA, 22 bp, Homo sapiens
tttggtgagctgcgagtgagga

SEQ ID NO: 10041780 - DNA, 22 bp, Homo sapiens
tttggttaatttaggcttgcat

SEQ ID NO: 10041781 - DNA, 22 bp, Homo sapiens
tttggtcaaatattatcctgag

SEQ ID NO: 10041782 - DNA, 22 bp, Homo sapiens
tttggtcagggtaggacagttg

SEQ ID NO: 10041783 - DNA, 22 bp, Homo sapiens
tttgataacagtgaatatcatg

SEQ ID NO: 10041784 - DNA, 17 bp, Homo sapiens
tttgatagaatcagagt

SEQ ID NO: 10041785 - DNA, 19 bp, Homo sapiens
tttgatagggcataatata

SEQ ID NO: 10041786 - DNA, 21 bp, Homo sapiens
tttctttctggctctcacagt

SEQ ID NO: 10041787 - DNA, 22 bp, Homo sapiens
tttcttttacagtgtggctatt

SEQ ID NO: 10041788 - DNA, 22 bp, Homo sapiens
tttcttttccaatatccctact

SEQ ID NO: 10041789 - DNA, 19 bp, Homo sapiens
tttcttttcccctcagcac

SEQ ID NO: 10041790 - DNA, 22 bp, Homo sapiens
tttcttttgctgagaggggcac

SEQ ID NO: 10041791 - DNA, 22 bp, Homo sapiens
tttcttttgccctgtgggttag

SEQ ID NO: 10041792 - DNA, 22 bp, Homo sapiens
tttcttttgaatagtgtgtggt

SEQ ID NO: 10041793 - DNA, 22 bp, Homo sapiens
tttgacaagagggcatcttcag

SEQ ID NO: 10041794 - DNA, 22 bp, Homo sapiens
tttgacaacacgttatttgcct

SEQ ID NO: 10041795 - DNA, 22 bp, Homo sapiens
tttgacaaaattatgctaatat

SEQ ID NO: 10041796 - DNA, 22 bp, Homo sapiens
ttctttgttgtactttcctaca

SEQ ID NO: 10041797 - DNA, 20 bp, Homo sapiens
ttctttgttccttacatttg

SEQ ID NO: 10041798 - DNA, 22 bp, Homo sapiens
ttctttggtgttacccagctca

SEQ ID NO: 10041799 - DNA, 19 bp, Homo sapiens
ttctttggtggtggtgacc

SEQ ID NO: 10041800 - DNA, 22 bp, Homo sapiens
ttctttgtgcatccaattttct

SEQ ID NO: 10041801 - DNA, 22 bp, Homo sapiens
ttcttcaaccatctacataaac

SEQ ID NO: 10041802 - DNA, 22 bp, Homo sapiens
ttctttggtgggagattgaggt

SEQ ID NO: 10041803 - DNA, 22 bp, Homo sapiens
ttcttcaattttccatatactg

SEQ ID NO: 10041804 - DNA, 22 bp, Homo sapiens
ttgaacattaacttcagtctat

SEQ ID NO: 10041805 - DNA, 19 bp, Homo sapiens
ttctgtaaggacattaatc

SEQ ID NO: 10041806 - DNA, 22 bp, Homo sapiens
ttctcagatgattcagataaac

SEQ ID NO: 10041807 - DNA, 22 bp, Homo sapiens
ttctcagatccatcagaagtcc

SEQ ID NO: 10041808 - DNA, 22 bp, Homo sapiens
ttccttgtggaaactatggacg

SEQ ID NO: 10041809 - DNA, 22 bp, Homo sapiens
ttccttggtgtaactgctccta

SEQ ID NO: 10041810 - DNA, 22 bp, Homo sapiens
ttccttggtagggacaactctg

SEQ ID NO: 10041811 - DNA, 22 bp, Homo sapiens
ttctccaaggatacagtcctgt

SEQ ID NO: 10041812 - DNA, 22 bp, Homo sapiens
ttcctgcgcccttctcgcccgc

SEQ ID NO: 10041813 - DNA, 22 bp, Homo sapiens
ttagcttgtgccatatgaaact

SEQ ID NO: 10041814 - DNA, 22 bp, Homo sapiens
ttagcttgcaaatggaaatgat

SEQ ID NO: 10041815 - DNA, 22 bp, Homo sapiens
ttatatatcttgatttgttcca

SEQ ID NO: 10041816 - DNA, 22 bp, Homo sapiens
ttatatatatgtagaggtcacg

SEQ ID NO: 10041817 - DNA, 22 bp, Homo sapiens
ttatatgattgaagtgcataag

SEQ ID NO: 10041818 - DNA, 22 bp, Homo sapiens
ttatatgagtatcatatcactt

SEQ ID NO: 10041819 - DNA, 22 bp, Homo sapiens
ttggccatctaagcccagccac

SEQ ID NO: 10041820 - DNA, 22 bp, Homo sapiens
ttggcccacagtaccatgctgt

SEQ ID NO: 10041821 - DNA, 22 bp, Homo sapiens
ttgggcccatggggctaagcta

SEQ ID NO: 10041822 - DNA, 22 bp, Homo sapiens
ttgggagatattgttctttaca

SEQ ID NO: 10041823 - DNA, 20 bp, Homo sapiens
ttggcagttaagaatcttac

SEQ ID NO: 10041824 - DNA, 22 bp, Homo sapiens
ttgtaagtcacaccagggcagg

SEQ ID NO: 10041825 - DNA, 22 bp, Homo sapiens
ttgctctgattaggtggaaaca

SEQ ID NO: 10041826 - DNA, 22 bp, Homo sapiens
ttgctctgtaataatctggggt

SEQ ID NO: 10041827 - DNA, 22 bp, Homo sapiens
ttgctgtgaaaccatgggaagt

SEQ ID NO: 10041828 - DNA, 22 bp, Homo sapiens
ttgcagaatacttattctgtat

SEQ ID NO: 10041829 - DNA, 22 bp, Homo sapiens
tttatatagagatttgtgcatg

SEQ ID NO: 10041830 - DNA, 22 bp, Homo sapiens
tttatataacagagactgctat

SEQ ID NO: 10041831 - DNA, 22 bp, Homo sapiens
gacagtggttccaaggcagctt

SEQ ID NO: 10041832 - DNA, 22 bp, Homo sapiens
gacagtggattcatctagtcaa

SEQ ID NO: 10041833 - DNA, 22 bp, Homo sapiens
gaccctccactcactgctgtgt

SEQ ID NO: 10041834 - DNA, 22 bp, Homo sapiens
gacagggaggaaagagactgct

SEQ ID NO: 10041835 - DNA, 22 bp, Homo sapiens
atgcctctgctcttggtcctca

SEQ ID NO: 10041836 - DNA, 22 bp, Homo sapiens
gaagcagaaggtttggacgtgc

SEQ ID NO: 10041837 - DNA, 22 bp, Homo sapiens
gaaaataggcagatgcattgta

SEQ ID NO: 10041838 - DNA, 22 bp, Homo sapiens
atgaagcagttaaggtgcatga

SEQ ID NO: 10041839 - DNA, 22 bp, Homo sapiens
atgaatcaaactgtacactgag

SEQ ID NO: 10041840 - DNA, 22 bp, Homo sapiens
atgcacaagaggctagaaaaga

SEQ ID NO: 10041841 - DNA, 21 bp, Homo sapiens
atgcacaaaaagactctttct

SEQ ID NO: 10041842 - DNA, 22 bp, Homo sapiens
gagctttgctggaagcctgggg

SEQ ID NO: 10041843 - DNA, 22 bp, Homo sapiens
gagctttggggaagaatacaga

SEQ ID NO: 10041844 - DNA, 22 bp, Homo sapiens
gagctttgcattattcagaagc

SEQ ID NO: 10041845 - DNA, 22 bp, Homo sapiens
gagctttgcctaaaactagaat

SEQ ID NO: 10041846 - DNA, 22 bp, Homo sapiens
gagctttgtaaaaaacttgcac

SEQ ID NO: 10041847 - DNA, 22 bp, Homo sapiens
gagctttggtgccaagtatttg

SEQ ID NO: 10041848 - DNA, 22 bp, Homo sapiens
gagctttgtcccttgggggctc

SEQ ID NO: 10041849 - DNA, 22 bp, Homo sapiens
gagctttgtagcaggaaggaag

SEQ ID NO: 10041850 - DNA, 22 bp, Homo sapiens
gagctttgtctcctggagaccc

SEQ ID NO: 10041851 - DNA, 22 bp, Homo sapiens
gagctttgttccgtggtggcac

SEQ ID NO: 10041852 - DNA, 22 bp, Homo sapiens
gagctttgtgctggtaggtggt

SEQ ID NO: 10041853 - DNA, 22 bp, Homo sapiens
gagctttgatcgctaagcctca

SEQ ID NO: 10041854 - DNA, 22 bp, Homo sapiens
gagctttgagattcttatggta

SEQ ID NO: 10041855 - DNA, 22 bp, Homo sapiens
gagcctgggtccttccctggga

SEQ ID NO: 10041856 - DNA, 22 bp, Homo sapiens
gagcagggagacaactctggtg

SEQ ID NO: 10041857 - DNA, 22 bp, Homo sapiens
gagcagtgaagacagaagtaca

SEQ ID NO: 10041858 - DNA, 21 bp, Homo sapiens
atggaaaaacaggtagagcat

SEQ ID NO: 10041859 - DNA, 22 bp, Homo sapiens
atgtttcagttctaaagttaga

SEQ ID NO: 10041860 - DNA, 22 bp, Homo sapiens
atgtttcagggtgatagaaggt

SEQ ID NO: 10041861 - DNA, 22 bp, Homo sapiens
atgtttcagatacagatcaaat

SEQ ID NO: 10041862 - DNA, 22 bp, Homo sapiens
gagtccaggctggtcaaatagc

SEQ ID NO: 10041863 - DNA, 22 bp, Homo sapiens
gagggatgtgcctgaaggcagg

SEQ ID NO: 10041864 - DNA, 22 bp, Homo sapiens
gaggtagcgagtggacagtgca

SEQ ID NO: 10041865 - DNA, 22 bp, Homo sapiens
caaatcatggaataactagaga

SEQ ID NO: 10041866 - DNA, 22 bp, Homo sapiens
gcccagcccctgggtggacgtg

SEQ ID NO: 10041867 - DNA, 23 bp, Homo sapiens
gccctgcccttagcacactcaca

SEQ ID NO: 10041868 - DNA, 22 bp, Homo sapiens
gccctgccctgagccgtagacc

SEQ ID NO: 10041869 - DNA, 22 bp, Homo sapiens
gcccagccacagtcactttcat

SEQ ID NO: 10041870 - DNA, 22 bp, Homo sapiens
gcccagccagagctgtgtgatg

SEQ ID NO: 10041871 - DNA, 22 bp, Homo sapiens
gcccagcccagaaaggttcgga

SEQ ID NO: 10041872 - DNA, 22 bp, Homo sapiens
gcctgcctagaattgcagcttt

SEQ ID NO: 10041873 - DNA, 22 bp, Homo sapiens
gcagaagtggtgctgtgccact

SEQ ID NO: 10041874 - DNA, 21 bp, Homo sapiens
gcagaagtggctacatctcca

SEQ ID NO: 10041875 - DNA, 22 bp, Homo sapiens
gcagaagtggattctacaattt

SEQ ID NO: 10041876 - DNA, 22 bp, Homo sapiens
gcagaagtggattctacaattt

SEQ ID NO: 10041877 - DNA, 22 bp, Homo sapiens
gcagatgaagtttacaggaaac

SEQ ID NO: 10041878 - DNA, 20 bp, Homo sapiens
gcagatgagactcacagagg

SEQ ID NO: 10041879 - DNA, 18 bp, Homo sapiens
gcaggagatgggtggggt

SEQ ID NO: 10041880 - DNA, 22 bp, Homo sapiens
gcaggagagtctgtgccaggtt

SEQ ID NO: 10041881 - DNA, 22 bp, Homo sapiens
gcagccttccgtggacctggac

SEQ ID NO: 10041882 - DNA, 17 bp, Homo sapiens
gcagcctcttggtagtg

SEQ ID NO: 10041883 - DNA, 22 bp, Homo sapiens
gcagatgatgtagacagacagt

SEQ ID NO: 10041884 - DNA, 22 bp, Homo sapiens
gcactgggggcagcagtgaggg

SEQ ID NO: 10041885 - DNA, 22 bp, Homo sapiens
gcactggggtcatagcctccag

SEQ ID NO: 10041886 - DNA, 22 bp, Homo sapiens
gcactgggtgggagatctgaat

SEQ ID NO: 10041887 - DNA, 22 bp, Homo sapiens
gcactgggtgtgaggcagcgtc

SEQ ID NO: 10041888 - DNA, 22 bp, Homo sapiens
gcactgggtgtgaggcagcgtc

SEQ ID NO: 10041889 - DNA, 23 bp, Homo sapiens
gcactgggctctcagcaaggtgt

SEQ ID NO: 10041890 - DNA, 22 bp, Homo sapiens
gcactgggggcagcagtgaggg

SEQ ID NO: 10041891 - DNA, 22 bp, Homo sapiens
gcacagggaggctggcctggcc

SEQ ID NO: 10041892 - DNA, 22 bp, Homo sapiens
gcacagggcaacaggtctgtta

SEQ ID NO: 10041893 - DNA, 22 bp, Homo sapiens
gcacagggagacagccgtggcc

SEQ ID NO: 10041894 - DNA, 21 bp, Homo sapiens
gcaaccagaccacagggcagt

SEQ ID NO: 10041895 - DNA, 22 bp, Homo sapiens
gcaaaaaatgcttgttgcttag

SEQ ID NO: 10041896 - DNA, 22 bp, Homo sapiens
gcaggatgccagggcagcagcg

SEQ ID NO: 10041897 - DNA, 22 bp, Homo sapiens
gcaggatgaaggcagaggctga

SEQ ID NO: 10041898 - DNA, 22 bp, Homo sapiens
gcaggatgagtgagtacattta

SEQ ID NO: 10041899 - DNA, 22 bp, Homo sapiens
gcaggatgcaacagcttgtagt

SEQ ID NO: 10041900 - DNA, 22 bp, Homo sapiens
gcagtgcatgtcggaactcatt

SEQ ID NO: 10041901 - DNA, 22 bp, Homo sapiens
ggcttgcttcttgtccaggaat

SEQ ID NO: 10041902 - DNA, 22 bp, Homo sapiens
ggctgcctttagaacggatgct

SEQ ID NO: 10041903 - DNA, 22 bp, Homo sapiens
ggctgccttgaccctggctccg

SEQ ID NO: 10041904 - DNA, 19 bp, Homo sapiens
ggctcctggggctcagccc

SEQ ID NO: 10041905 - DNA, 22 bp, Homo sapiens
ggcgctcagtgttgccccagag

SEQ ID NO: 10041906 - DNA, 22 bp, Homo sapiens
ggatcaagaaagtcagatgaag

SEQ ID NO: 10041907 - DNA, 23 bp, Homo sapiens
ggataaatctcagcttcttccat

SEQ ID NO: 10041908 - DNA, 22 bp, Homo sapiens
ggcagtcacaggggagactggg

SEQ ID NO: 10041909 - DNA, 22 bp, Homo sapiens
ggcagtcaagagggagtctgaa

SEQ ID NO: 10041910 - DNA, 22 bp, Homo sapiens
ggcaggttggatgctgtagtga

SEQ ID NO: 10041911 - DNA, 22 bp, Homo sapiens
ggcaggagaaaggtctcttctt

SEQ ID NO: 10041912 - DNA, 22 bp, Homo sapiens
cacatgcagttttccagcagtc

SEQ ID NO: 10041913 - DNA, 22 bp, Homo sapiens
ggccccagcagaccctcctctg

SEQ ID NO: 10041914 - DNA, 22 bp, Homo sapiens
ggcccagcccgagtcagccttc

SEQ ID NO: 10041915 - DNA, 22 bp, Homo sapiens
ggcccagcatcttgtgaagttt

SEQ ID NO: 10041916 - DNA, 22 bp, Homo sapiens
ggcccagcacagtgcttggggg

SEQ ID NO: 10041917 - DNA, 22 bp, Homo sapiens
ggcccagagctccctggcacct

SEQ ID NO: 10041918 - DNA, 22 bp, Homo sapiens
ggcgccagcactgcagcgcctc

SEQ ID NO: 10041919 - DNA, 22 bp, Homo sapiens
ggcgccagcggtaagtaagaca

SEQ ID NO: 10041920 - DNA, 22 bp, Homo sapiens
ggccagcctggggctcccagac

SEQ ID NO: 10041921 - DNA, 22 bp, Homo sapiens
ggccagcctggggctcccagac

SEQ ID NO: 10041922 - DNA, 22 bp, Homo sapiens
cacccaggacaggccagatgtg

SEQ ID NO: 10041923 - DNA, 22 bp, Homo sapiens
cacccaggcaaggattctgcaa

SEQ ID NO: 10041924 - DNA, 22 bp, Homo sapiens
cacccaggcaggtggctgagaa

SEQ ID NO: 10041925 - DNA, 22 bp, Homo sapiens
caatcgtagttgaaatgaatct

SEQ ID NO: 10041926 - DNA, 22 bp, Homo sapiens
caagtgtgtaattactgggagc

SEQ ID NO: 10041927 - DNA, 22 bp, Homo sapiens
gctggccatggggagtgaggag

SEQ ID NO: 10041928 - DNA, 22 bp, Homo sapiens
gctggccatatattttgctgtt

SEQ ID NO: 10041929 - DNA, 22 bp, Homo sapiens
gctggccatggcctgcgccatc

SEQ ID NO: 10041930 - DNA, 22 bp, Homo sapiens
gctggccagtgtggtgaccacc

SEQ ID NO: 10041931 - DNA, 22 bp, Homo sapiens
gctggccatagaagccaaagag

SEQ ID NO: 10041932 - DNA, 22 bp, Homo sapiens
gctgggaggaatttggggaata

SEQ ID NO: 10041933 - DNA, 22 bp, Homo sapiens
gctggaggctggagtgcagtgg

SEQ ID NO: 10041934 - DNA, 22 bp, Homo sapiens
ggaggggcatagttcaccatca

SEQ ID NO: 10041935 - DNA, 22 bp, Homo sapiens
cacagccttgagcgaggacaag

SEQ ID NO: 10041936 - DNA, 22 bp, Homo sapiens
cacagcaggcactatacagggc

SEQ ID NO: 10041937 - DNA, 22 bp, Homo sapiens
cacagcagggcatggctgttgt

SEQ ID NO: 10041938 - DNA, 21 bp, Homo sapiens
cacagcagggttcctgggctc

SEQ ID NO: 10041939 - DNA, 22 bp, Homo sapiens
ggagcaggagtctcttgaattt

SEQ ID NO: 10041940 - DNA, 22 bp, Homo sapiens
ggaggagcacttctgagctcag

SEQ ID NO: 10041941 - DNA, 22 bp, Homo sapiens
ggacaagcctgtgagtgggttt

SEQ ID NO: 10041942 - DNA, 22 bp, Homo sapiens
ggacaaaggtagacagtctctg

SEQ ID NO: 10041943 - DNA, 22 bp, Homo sapiens
cacagagaactgtgggagtgtg

SEQ ID NO: 10041944 - DNA, 22 bp, Homo sapiens
cacagagaatgatgagtcactg

SEQ ID NO: 10041945 - DNA, 22 bp, Homo sapiens
ggtgagaggcagaggacagctt

SEQ ID NO: 10041946 - DNA, 22 bp, Homo sapiens
ggtgagaggcagaggacagctt

SEQ ID NO: 10041947 - DNA, 22 bp, Homo sapiens
cagcagagaccaagtgatttga

SEQ ID NO: 10041948 - DNA, 22 bp, Homo sapiens
cagcagaagtccgactccagtc

SEQ ID NO: 10041949 - DNA, 20 bp, Homo sapiens
cagcagagacccatggggag

SEQ ID NO: 10041950 - DNA, 22 bp, Homo sapiens
cagcagaacagttaaagaaacc

SEQ ID NO: 10041951 - DNA, 22 bp, Homo sapiens
cagcagaagcaacattcaggct

SEQ ID NO: 10041952 - DNA, 22 bp, Homo sapiens
gggccctggatttaagcatgga

SEQ ID NO: 10041953 - DNA, 22 bp, Homo sapiens
gggccctggccgaatccctctg

SEQ ID NO: 10041954 - DNA, 22 bp, Homo sapiens
gggccctggacgtggcggcaga

SEQ ID NO: 10041955 - DNA, 22 bp, Homo sapiens
gggccctgcgactcgcggcgga

SEQ ID NO: 10041956 - DNA, 22 bp, Homo sapiens
gggccctgcgtccggaagtctg

SEQ ID NO: 10041957 - DNA, 18 bp, Homo sapiens
gggccctggcgtccgccc

SEQ ID NO: 10041958 - DNA, 22 bp, Homo sapiens
gggccctggctttcctgttctt

SEQ ID NO: 10041959 - DNA, 22 bp, Homo sapiens
cagaagagtagctgaacaagtt

SEQ ID NO: 10041960 - DNA, 22 bp, Homo sapiens
gggctcaggcctggcctctcac

SEQ ID NO: 10041961 - DNA, 22 bp, Homo sapiens
cagccgcgctcgtgccagacag

SEQ ID NO: 10041962 - DNA, 22 bp, Homo sapiens
gtctttggaaagacaaagttca

SEQ ID NO: 10041963 - DNA, 22 bp, Homo sapiens
gtctttggaggcactgttgagt

SEQ ID NO: 10041964 - DNA, 22 bp, Homo sapiens
gtctttggagaggtgccatttc

SEQ ID NO: 10041965 - DNA, 18 bp, Homo sapiens
gtctttggagtggaggta

SEQ ID NO: 10041966 - DNA, 22 bp, Homo sapiens
gtctttggatgtaagataaagt

SEQ ID NO: 10041967 - DNA, 22 bp, Homo sapiens
cagcagagcatttggtaggagg

SEQ ID NO: 10041968 - DNA, 22 bp, Homo sapiens
cagcagagacggtaagcagaac

SEQ ID NO: 10041969 - DNA, 22 bp, Homo sapiens
cagcagtaactcccgtgcagca

SEQ ID NO: 10041970 - DNA, 22 bp, Homo sapiens
cagcagtgcttcagtgtgagat

SEQ ID NO: 10041971 - DNA, 22 bp, Homo sapiens
cagcagtggaactacccaggga

SEQ ID NO: 10041972 - DNA, 22 bp, Homo sapiens
gtcctctgtgtaggctgcagac

SEQ ID NO: 10041973 - DNA, 22 bp, Homo sapiens
cagcatgcagcccctggcagct

SEQ ID NO: 10041974 - DNA, 22 bp, Homo sapiens
agggtaggaactgagtggaagg

SEQ ID NO: 10041975 - DNA, 23 bp, Homo sapiens
aggggcagcaagttttggtgtta

SEQ ID NO: 10041976 - DNA, 22 bp, Homo sapiens
agggccttgctgtctgaagctg

SEQ ID NO: 10041977 - DNA, 22 bp, Homo sapiens
agggcctccagggcagcagtgg

SEQ ID NO: 10041978 - DNA, 22 bp, Homo sapiens
cccatgggttttcctccctgcc

SEQ ID NO: 10041979 - DNA, 22 bp, Homo sapiens
cccatgcaccctctaagaagga

SEQ ID NO: 10041980 - DNA, 22 bp, Homo sapiens
ccctagggtttggccagagccc

SEQ ID NO: 10041981 - DNA, 22 bp, Homo sapiens
cccaggagatgcactccattgg

SEQ ID NO: 10041982 - DNA, 23 bp, Homo sapiens
cccaggagcctgagtcctctctg

SEQ ID NO: 10041983 - DNA, 22 bp, Homo sapiens
cccaggagggtggcctctgccc

SEQ ID NO: 10041984 - DNA, 22 bp, Homo sapiens
cccaggcctggtctgggccagt

SEQ ID NO: 10041985 - DNA, 22 bp, Homo sapiens
cccagtcatcctgcaggtgaaa

SEQ ID NO: 10041986 - DNA, 22 bp, Homo sapiens
aggcccagactcagcggggcgg

SEQ ID NO: 10041987 - DNA, 22 bp, Homo sapiens
aggccacatagcttgcatgtag

SEQ ID NO: 10041988 - DNA, 22 bp, Homo sapiens
ccagaaaatatggctaaggtga

SEQ ID NO: 10041989 - DNA, 22 bp, Homo sapiens
aggcgtgggaggatctgaggcc

SEQ ID NO: 10041990 - DNA, 22 bp, Homo sapiens
ccagggcctgagggcgacgccc

SEQ ID NO: 10041991 - DNA, 22 bp, Homo sapiens
ccagggcctgagggcgacgccc

SEQ ID NO: 10041992 - DNA, 22 bp, Homo sapiens
aggcgtggttgaggcgagcata

SEQ ID NO: 10041993 - DNA, 22 bp, Homo sapiens
agctggagatcatgctgatact

SEQ ID NO: 10041994 - DNA, 20 bp, Homo sapiens
caggcagaggatgctgacca

SEQ ID NO: 10041995 - DNA, 20 bp, Homo sapiens
aggaaggagaatctgagcaa

SEQ ID NO: 10041996 - DNA, 22 bp, Homo sapiens
cagggtggggctggctatcaaa

SEQ ID NO: 10041997 - DNA, 22 bp, Homo sapiens
cagggtggtgaatagctatagt

SEQ ID NO: 10041998 - DNA, 22 bp, Homo sapiens
cagggtggtaccagcatctagt

SEQ ID NO: 10041999 - DNA, 22 bp, Homo sapiens
cagggacccgcacaggtagcat

SEQ ID NO: 10042000 - DNA, 22 bp, Homo sapiens
cagggacattggtggccaggtt

SEQ ID NO: 10042001 - DNA, 22 bp, Homo sapiens
aggcacagtgcctggaatcaaa

SEQ ID NO: 10042002 - DNA, 19 bp, Homo sapiens
aggcacaggttgtctggac

SEQ ID NO: 10042003 - DNA, 22 bp, Homo sapiens
aggcactgaaaggtggccagag

SEQ ID NO: 10042004 - DNA, 22 bp, Homo sapiens
aggcactgaatatccagtaaaa

SEQ ID NO: 10042005 - DNA, 23 bp, Homo sapiens
aggcactgaatgtgtcagtgagt

SEQ ID NO: 10042006 - DNA, 22 bp, Homo sapiens
aggcactgactcaagggagcca

SEQ ID NO: 10042007 - DNA, 23 bp, Homo sapiens
aggatcctggtacaggagcagag

SEQ ID NO: 10042008 - DNA, 22 bp, Homo sapiens
aggcacagggatgcggagccag

SEQ ID NO: 10042009 - DNA, 22 bp, Homo sapiens
aggagtggtgcaggacctgcca

SEQ ID NO: 10042010 - DNA, 22 bp, Homo sapiens
aggagtgggggcgagaagttaa

SEQ ID NO: 10042011 - DNA, 22 bp, Homo sapiens
cagtgcttttaaaacaacatca

SEQ ID NO: 10042012 - DNA, 22 bp, Homo sapiens
aggagctggcctagaaaggaga

SEQ ID NO: 10042013 - DNA, 22 bp, Homo sapiens
atctgtcttgccttgcatattt

SEQ ID NO: 10042014 - DNA, 22 bp, Homo sapiens
atctgtctatgtggctatgtat

SEQ ID NO: 10042015 - DNA, 22 bp, Homo sapiens
cttcttaatcataacggtatct

SEQ ID NO: 10042016 - DNA, 22 bp, Homo sapiens
cttcttaatcccttatatattt

SEQ ID NO: 10042017 - DNA, 22 bp, Homo sapiens
cttcttaactgtatatactatg

SEQ ID NO: 10042018 - DNA, 22 bp, Homo sapiens
cttcttaaagattacacaatga

SEQ ID NO: 10042019 - DNA, 22 bp, Homo sapiens
cttccttggcttctggggtgtg

SEQ ID NO: 10042020 - DNA, 22 bp, Homo sapiens
cttccttgtggtccttctcatt

SEQ ID NO: 10042021 - DNA, 22 bp, Homo sapiens
cttctgacccctggtctacagc

SEQ ID NO: 10042022 - DNA, 22 bp, Homo sapiens
cttccttgcggcccctgcctag

SEQ ID NO: 10042023 - DNA, 19 bp, Homo sapiens
cttccttgctccccatgtg

SEQ ID NO: 10042024 - DNA, 22 bp, Homo sapiens
cttccttgctgtctgctccagg

SEQ ID NO: 10042025 - DNA, 22 bp, Homo sapiens
ctgggaggacaacttggagctc

SEQ ID NO: 10042026 - DNA, 22 bp, Homo sapiens
ctgggagcttgttaggaatgca

SEQ ID NO: 10042027 - DNA, 22 bp, Homo sapiens
atcataaagtgctatctgattg

SEQ ID NO: 10042028 - DNA, 22 bp, Homo sapiens
atcagcaggaagggcaccttta

SEQ ID NO: 10042029 - DNA, 22 bp, Homo sapiens
atcagcagatgctcaatgaaca

SEQ ID NO: 10042030 - DNA, 22 bp, Homo sapiens
atcagcagtgtctacctcggtg

SEQ ID NO: 10042031 - DNA, 22 bp, Homo sapiens
ataaaagaagttttggtacttg

SEQ ID NO: 10042032 - DNA, 22 bp, Homo sapiens
ataaactctgcctcagaagagc

SEQ ID NO: 10042033 - DNA, 22 bp, Homo sapiens
ataaactcatgccaagaaatga

SEQ ID NO: 10042034 - DNA, 22 bp, Homo sapiens
ataaaatcagagttggattgga

SEQ ID NO: 10042035 - DNA, 22 bp, Homo sapiens
ataaaatcaactggctccagtt

SEQ ID NO: 10042036 - DNA, 22 bp, Homo sapiens
ataaaatctttatgtgctctgc

SEQ ID NO: 10042037 - DNA, 21 bp, Homo sapiens
atacacatacacataaatgtg

SEQ ID NO: 10042038 - DNA, 22 bp, Homo sapiens
atacacatgcacacatgtgtgt

SEQ ID NO: 10042039 - DNA, 22 bp, Homo sapiens
ctgcctggtgcggtgcccaccc

SEQ ID NO: 10042040 - DNA, 22 bp, Homo sapiens
ctgcctggggcatcagtcaagg

SEQ ID NO: 10042041 - DNA, 22 bp, Homo sapiens
ctggcccttctcttgcttcctg

SEQ ID NO: 10042042 - DNA, 22 bp, Homo sapiens
ctggcaggttatagagctgccc

SEQ ID NO: 10042043 - DNA, 22 bp, Homo sapiens
ctggcacacagcaggctctcag

SEQ ID NO: 10042044 - DNA, 22 bp, Homo sapiens
ctggcacacagaggccctcggg

SEQ ID NO: 10042045 - DNA, 22 bp, Homo sapiens
ctggcacagccactgcaggcag

SEQ ID NO: 10042046 - DNA, 22 bp, Homo sapiens
ctggcacagttaacatatgcta

SEQ ID NO: 10042047 - DNA, 22 bp, Homo sapiens
atacatgtgggtctaaacatat

SEQ ID NO: 10042048 - DNA, 23 bp, Homo sapiens
atataaacaccagatagattgta

SEQ ID NO: 10042049 - DNA, 22 bp, Homo sapiens
ctgggagctggaatgggagaag

SEQ ID NO: 10042050 - DNA, 22 bp, Homo sapiens
ctgggagctgtcaggagcgtgt

SEQ ID NO: 10042051 - DNA, 22 bp, Homo sapiens
ctgggagctggatgccctgccc

SEQ ID NO: 10042052 - DNA, 20 bp, Homo sapiens
atataccatcccacaacagg

SEQ ID NO: 10042053 - DNA, 22 bp, Homo sapiens
atatactgtaggccactataag

SEQ ID NO: 10042054 - DNA, 22 bp, Homo sapiens
atataatagtttcataaaggct

SEQ ID NO: 10042055 - DNA, 22 bp, Homo sapiens
atatacacatgtgtatacattt

SEQ ID NO: 10042056 - DNA, 22 bp, Homo sapiens
agtgtgcatttgcagaagaccc

SEQ ID NO: 10042057 - DNA, 22 bp, Homo sapiens
agtgtgggccacgcagctgagc

SEQ ID NO: 10042058 - DNA, 22 bp, Homo sapiens
agtgaggggattcaggcaaggt

SEQ ID NO: 10042059 - DNA, 22 bp, Homo sapiens
agtctttatacagaaatatatg

SEQ ID NO: 10042060 - DNA, 22 bp, Homo sapiens
agtctttccttttggaagaaaa

SEQ ID NO: 10042061 - DNA, 22 bp, Homo sapiens
agtgcttttatatcattaatcc

SEQ ID NO: 10042062 - DNA, 22 bp, Homo sapiens
agtgcttttgtcattgaatctt

SEQ ID NO: 10042063 - DNA, 22 bp, Homo sapiens
agtgctttgtagtttcattgtg

SEQ ID NO: 10042064 - DNA, 22 bp, Homo sapiens
agtggagtgagtggcagaagga

SEQ ID NO: 10042065 - DNA, 22 bp, Homo sapiens
agtggcatctctctaatgacga

SEQ ID NO: 10042066 - DNA, 18 bp, Homo sapiens
agtgccagctctgctttc

SEQ ID NO: 10042067 - DNA, 22 bp, Homo sapiens
agtagatagagtaagataccga

SEQ ID NO: 10042068 - DNA, 22 bp, Homo sapiens
agtagcagaaggtcttgaaggg

SEQ ID NO: 10042069 - DNA, 22 bp, Homo sapiens
agtagcagtgacagctgaggta

SEQ ID NO: 10042070 - DNA, 22 bp, Homo sapiens
agtagcagtttggctgaattta

SEQ ID NO: 10042071 - DNA, 20 bp, Homo sapiens
agtagcagtaatatggaaga

SEQ ID NO: 10042072 - DNA, 22 bp, Homo sapiens
agtaggcatagaaagaagcacc

SEQ ID NO: 10042073 - DNA, 22 bp, Homo sapiens
agtaggcagggaataatacaaa

SEQ ID NO: 10042074 - DNA, 22 bp, Homo sapiens
agtaaagcagagttgcagtaca

SEQ ID NO: 10042075 - DNA, 22 bp, Homo sapiens
ccttctccctctgagaggaacc

SEQ ID NO: 10042076 - DNA, 22 bp, Homo sapiens
ccttctcccctctgcagggtgt

SEQ ID NO: 10042077 - DNA, 22 bp, Homo sapiens
ctatatatatcatcttccagtt

SEQ ID NO: 10042078 - DNA, 19 bp, Homo sapiens
agggttacccgctgccacc

SEQ ID NO: 10042079 - DNA, 22 bp, Homo sapiens
aggtacagcaatataagaggtc

SEQ ID NO: 10042080 - DNA, 22 bp, Homo sapiens
aggtacagatgaaagtctagtt

SEQ ID NO: 10042081 - DNA, 22 bp, Homo sapiens
cctgggaggctgaggctgcagt

SEQ ID NO: 10042082 - DNA, 22 bp, Homo sapiens
cctgtgccagctgggccctgcc

SEQ ID NO: 10042083 - DNA, 22 bp, Homo sapiens
aggtgcagcatgagtccaacgg

SEQ ID NO: 10042084 - DNA, 22 bp, Homo sapiens
cctggggctccagagcagcgga

SEQ ID NO: 10042085 - DNA, 22 bp, Homo sapiens
cctggggctctgcacagagcag

SEQ ID NO: 10042086 - DNA, 22 bp, Homo sapiens
cctgttgtttagcacttagaac

SEQ ID NO: 10042087 - DNA, 22 bp, Homo sapiens
aggtgacatcccggcagcagag

SEQ ID NO: 10042088 - DNA, 22 bp, Homo sapiens
aggtgagaaaacgagggttgca

SEQ ID NO: 10042089 - DNA, 21 bp, Homo sapiens
aggtgggcaggtggagtggcc

SEQ ID NO: 10042090 - DNA, 22 bp, Homo sapiens
aggtgggcggattcatgaggtc

SEQ ID NO: 10042091 - DNA, 22 bp, Homo sapiens
actccctgtacttgcctctctt

SEQ ID NO: 10042092 - DNA, 22 bp, Homo sapiens
actctgaaatagaggctggtgg

SEQ ID NO: 10042093 - DNA, 22 bp, Homo sapiens
actctgaactccaggaggctca

SEQ ID NO: 10042094 - DNA, 22 bp, Homo sapiens
actgagagtcaagatagcatgg

SEQ ID NO: 10042095 - DNA, 22 bp, Homo sapiens
actgcacttcaccctgggtgac

SEQ ID NO: 10042096 - DNA, 22 bp, Homo sapiens
actgcactccagcctgggtgat

SEQ ID NO: 10042097 - DNA, 22 bp, Homo sapiens
actgcactcctgcctgggtaac

SEQ ID NO: 10042098 - DNA, 22 bp, Homo sapiens
actgcacttacatagaggaggc

SEQ ID NO: 10042099 - DNA, 22 bp, Homo sapiens
actgcactccagcctgggtgac

SEQ ID NO: 10042100 - DNA, 19 bp, Homo sapiens
ataaataaaaagtgggaga

SEQ ID NO: 10042101 - DNA, 22 bp, Homo sapiens
agttttatggctcaacctaata

SEQ ID NO: 10042102 - DNA, 22 bp, Homo sapiens
atacatcatttatggaataagg

SEQ ID NO: 10042103 - DNA, 22 bp, Homo sapiens
atacatcaaggatgatggtgta

SEQ ID NO: 10042104 - DNA, 22 bp, Homo sapiens
atacaaaatatatactggagac

SEQ ID NO: 10042105 - DNA, 21 bp, Homo sapiens
atcagtaaggttggaggaaga

SEQ ID NO: 10042106 - DNA, 20 bp, Homo sapiens
agcttcagccctaggattgc

SEQ ID NO: 10042107 - DNA, 17 bp, Homo sapiens
agcttcagttgcaaaac

SEQ ID NO: 10042108 - DNA, 20 bp, Homo sapiens
agctccagtgctgacgcttc

SEQ ID NO: 10042109 - DNA, 22 bp, Homo sapiens
agctgcaggaagtagaagcgga

SEQ ID NO: 10042110 - DNA, 22 bp, Homo sapiens
agctgcaggagtcgcctaggat

SEQ ID NO: 10042111 - DNA, 22 bp, Homo sapiens
aggagggacaccaatatatgtt

SEQ ID NO: 10042112 - DNA, 22 bp, Homo sapiens
aggagggaataagaaagagtca

SEQ ID NO: 10042113 - DNA, 17 bp, Homo sapiens
aggagggaaatagcttg

SEQ ID NO: 10042114 - DNA, 22 bp, Homo sapiens
aggagggacctaggaatattgc

SEQ ID NO: 10042115 - DNA, 20 bp, Homo sapiens
aggagggacctggattggcg

SEQ ID NO: 10042116 - DNA, 20 bp, Homo sapiens
aggagggacctggattggcg

SEQ ID NO: 10042117 - DNA, 22 bp, Homo sapiens
aggagggagatgcccatcctgg

SEQ ID NO: 10042118 - DNA, 22 bp, Homo sapiens
acagggtgaatgtgacattatc

SEQ ID NO: 10042119 - DNA, 22 bp, Homo sapiens
acagggtgactttgtgacagat

SEQ ID NO: 10042120 - DNA, 22 bp, Homo sapiens
aggccacagagagtgcatgtgc

SEQ ID NO: 10042121 - DNA, 21 bp, Homo sapiens
aggcccaggaatatgcatttt

SEQ ID NO: 10042122 - DNA, 21 bp, Homo sapiens
aggcccagctttcctcttgct

SEQ ID NO: 10042123 - DNA, 22 bp, Homo sapiens
aggcccagggctgctctctgaa

SEQ ID NO: 10042124 - DNA, 22 bp, Homo sapiens
aggcccagggctgctctctgaa

SEQ ID NO: 10042125 - DNA, 23 bp, Homo sapiens
aggcccaggtatgtttgttttgg

SEQ ID NO: 10042126 - DNA, 22 bp, Homo sapiens
aggcccagcttgaagtgggaag

SEQ ID NO: 10042127 - DNA, 21 bp, Homo sapiens
aggcccagctttcctcttgct

SEQ ID NO: 10042128 - DNA, 22 bp, Homo sapiens
aggcccagctgggccaggaaca

SEQ ID NO: 10042129 - DNA, 22 bp, Homo sapiens
aggcccagctgggccaggaaca

SEQ ID NO: 10042130 - DNA, 22 bp, Homo sapiens
aggccctgcaggaagcaggatg

SEQ ID NO: 10042131 - DNA, 22 bp, Homo sapiens
acattcttggactccactctag

SEQ ID NO: 10042132 - DNA, 18 bp, Homo sapiens
aggcttcccaggcaggcc

SEQ ID NO: 10042133 - DNA, 22 bp, Homo sapiens
accatacacaatttgcaacggt

SEQ ID NO: 10042134 - DNA, 23 bp, Homo sapiens
aggcttcctatcttagagctggg

SEQ ID NO: 10042135 - DNA, 22 bp, Homo sapiens
accctggagcttttctggccct

SEQ ID NO: 10042136 - DNA, 22 bp, Homo sapiens
accctggaggtggaggtgcagt

SEQ ID NO: 10042137 - DNA, 22 bp, Homo sapiens
accctggaggtctacagtgcag

SEQ ID NO: 10042138 - DNA, 22 bp, Homo sapiens
accctggacatcttgtcatagc

SEQ ID NO: 10042139 - DNA, 22 bp, Homo sapiens
accctggactggggctgaggct

SEQ ID NO: 10042140 - DNA, 23 bp, Homo sapiens
agggcctctgtcccccagcactc

SEQ ID NO: 10042141 - DNA, 22 bp, Homo sapiens
agggcctctgagccagttctgg

SEQ ID NO: 10042142 - DNA, 21 bp, Homo sapiens
agggcctctcatttgtgccag

SEQ ID NO: 10042143 - DNA, 22 bp, Homo sapiens
agggcctctctgggcctttcct

SEQ ID NO: 10042144 - DNA, 22 bp, Homo sapiens
acccagggtcaccccgtagggt

SEQ ID NO: 10042145 - DNA, 22 bp, Homo sapiens
agatggagtctcactcttgttg

SEQ ID NO: 10042146 - DNA, 22 bp, Homo sapiens
agatggaggaaggctgaactca

SEQ ID NO: 10042147 - DNA, 22 bp, Homo sapiens
agatggagaccttggatgaact

SEQ ID NO: 10042148 - DNA, 22 bp, Homo sapiens
caaagcaccacaaaccaggtga

SEQ ID NO: 10042149 - DNA, 19 bp, Homo sapiens
atgaagcattgtttttgta

SEQ ID NO: 10042150 - DNA, 22 bp, Homo sapiens
atgaagcattacaggatgacag

SEQ ID NO: 10042151 - DNA, 22 bp, Homo sapiens
atgcctggtatgaagcaaggaa

SEQ ID NO: 10042152 - DNA, 22 bp, Homo sapiens
agagagggaatatttggggtat

SEQ ID NO: 10042153 - DNA, 22 bp, Homo sapiens
agagaagtgtcatttcagtttt

SEQ ID NO: 10042154 - DNA, 22 bp, Homo sapiens
agagcagagtggctgtagcttg

SEQ ID NO: 10042155 - DNA, 22 bp, Homo sapiens
agagcagagggctctgggacaa

SEQ ID NO: 10042156 - DNA, 22 bp, Homo sapiens
agagcagatggagctggaagag

SEQ ID NO: 10042157 - DNA, 22 bp, Homo sapiens
agccctgggcacctgtgagggg

SEQ ID NO: 10042158 - DNA, 22 bp, Homo sapiens
agccctgggcacctgtgagggg

SEQ ID NO: 10042159 - DNA, 22 bp, Homo sapiens
agccctggctcccagcagcgct

SEQ ID NO: 10042160 - DNA, 22 bp, Homo sapiens
agccctggcagagccaggtagt

SEQ ID NO: 10042161 - DNA, 22 bp, Homo sapiens
agccagtgcagctggaaattca

SEQ ID NO: 10042162 - DNA, 20 bp, Homo sapiens
agccccacccttgtcctggc

SEQ ID NO: 10042163 - DNA, 22 bp, Homo sapiens
agcccaggttgaggctgcagtg

SEQ ID NO: 10042164 - DNA, 22 bp, Homo sapiens
agccagcacggcgccatggagt

SEQ ID NO: 10042165 - DNA, 20 bp, Homo sapiens
cagagacccaggcttcagct

SEQ ID NO: 10042166 - DNA, 22 bp, Homo sapiens
cagagacccttctcagtggcca

SEQ ID NO: 10042167 - DNA, 23 bp, Homo sapiens
agctccagaacatagcacaggaa

SEQ ID NO: 10042168 - DNA, 22 bp, Homo sapiens
agcaggctgggcaatatgggca

SEQ ID NO: 10042169 - DNA, 22 bp, Homo sapiens
cacagcagacagggaggcggct

SEQ ID NO: 10042170 - DNA, 22 bp, Homo sapiens
cacagcagaaagtgtaggagga

SEQ ID NO: 10042171 - DNA, 21 bp, Homo sapiens
agcagctgggcaacatggagg

SEQ ID NO: 10042172 - DNA, 22 bp, Homo sapiens
cacagcaatagctaactgatac

SEQ ID NO: 10042173 - DNA, 22 bp, Homo sapiens
caccagcagaagactgagggtg

SEQ ID NO: 10042174 - DNA, 20 bp, Homo sapiens
caccagcagcagctgccacc

SEQ ID NO: 10042175 - DNA, 23 bp, Homo sapiens
caccactttctccttctccttgg

SEQ ID NO: 10042176 - DNA, 22 bp, Homo sapiens
agcaggttgttttgtggccagg

SEQ ID NO: 10042177 - DNA, 22 bp, Homo sapiens
agcagtggagcgagatgtttaa

SEQ ID NO: 10042178 - DNA, 22 bp, Homo sapiens
agcagtggcatacattttgagt

SEQ ID NO: 10042179 - DNA, 22 bp, Homo sapiens
agcagcagatcaaacaggcttg

SEQ ID NO: 10042180 - DNA, 22 bp, Homo sapiens
agcagcagatcaaacaggcttg

SEQ ID NO: 10042181 - DNA, 22 bp, Homo sapiens
agcagcagaggtcagaaaggta

SEQ ID NO: 10042182 - DNA, 22 bp, Homo sapiens
agcagcagagctctggtctgca

SEQ ID NO: 10042183 - DNA, 19 bp, Homo sapiens
agcagcagaagtgtgcctt

SEQ ID NO: 10042184 - DNA, 21 bp, Homo sapiens
agcagcagatctggtgagggc

SEQ ID NO: 10042185 - DNA, 22 bp, Homo sapiens
agcagccttaggtattgtgatt

SEQ ID NO: 10042186 - DNA, 22 bp, Homo sapiens
agcagccttgcaggggtcgcac

SEQ ID NO: 10042187 - DNA, 17 bp, Homo sapiens
agcagctggcacaggag

SEQ ID NO: 10042188 - DNA, 22 bp, Homo sapiens
cacagagattagaattagacta

SEQ ID NO: 10042189 - DNA, 22 bp, Homo sapiens
cacagaacatccttagctcatg

SEQ ID NO: 10042190 - DNA, 22 bp, Homo sapiens
agcagctcccctcatgctccac

SEQ ID NO: 10042191 - DNA, 22 bp, Homo sapiens
cacagagatcggaacagaagta

SEQ ID NO: 10042192 - DNA, 22 bp, Homo sapiens
caaaggcctgagaactgagggg

SEQ ID NO: 10042193 - DNA, 22 bp, Homo sapiens
agcactggagtttagtgggatt

SEQ ID NO: 10042194 - DNA, 22 bp, Homo sapiens
caatacaattaccagttaatca

SEQ ID NO: 10042195 - DNA, 21 bp, Homo sapiens
agcagaggcagaatgtatgca

SEQ ID NO: 10042196 - DNA, 22 bp, Homo sapiens
aatcttggcaaatgtagcttcc

SEQ ID NO: 10042197 - DNA, 22 bp, Homo sapiens
aatactgctgcctgcaaattat

SEQ ID NO: 10042198 - DNA, 22 bp, Homo sapiens
aatatcaggatgcaaagctgtg

SEQ ID NO: 10042199 - DNA, 21 bp, Homo sapiens
aagtttctccctaattgttgc

SEQ ID NO: 10042200 - DNA, 22 bp, Homo sapiens
aataaatgaacaaagcaggttg

SEQ ID NO: 10042201 - DNA, 22 bp, Homo sapiens
aataaaatggtcagttttctca

SEQ ID NO: 10042202 - DNA, 22 bp, Homo sapiens
acattagtttctcagatcattt

SEQ ID NO: 10042203 - DNA, 22 bp, Homo sapiens
acataatgagctctttataaat

SEQ ID NO: 10042204 - DNA, 22 bp, Homo sapiens
aaggttccctctctggaagcct

SEQ ID NO: 10042205 - DNA, 22 bp, Homo sapiens
aaggttcctctctccacccagc

SEQ ID NO: 10042206 - DNA, 22 bp, Homo sapiens
accaggcatgatgtggagcaca

SEQ ID NO: 10042207 - DNA, 22 bp, Homo sapiens
aagtaaaagctttaccatgcgc

SEQ ID NO: 10042208 - DNA, 22 bp, Homo sapiens
aaggtttttttccagtatctct

SEQ ID NO: 10042209 - DNA, 22 bp, Homo sapiens
accaggcactcttgtggcagtg

SEQ ID NO: 10042210 - DNA, 22 bp, Homo sapiens
accaggcagagctgggccttaa

SEQ ID NO: 10042211 - DNA, 22 bp, Homo sapiens
accaggcaactgtgaatgggct

SEQ ID NO: 10042212 - DNA, 22 bp, Homo sapiens
accaggcaaaaccacaggagca

SEQ ID NO: 10042213 - DNA, 22 bp, Homo sapiens
aagggcagcttaaattggtagc

SEQ ID NO: 10042214 - DNA, 22 bp, Homo sapiens
acattcttataagagtgaggca

SEQ ID NO: 10042215 - DNA, 22 bp, Homo sapiens
acattcttaacagttaaaaact

SEQ ID NO: 10042216 - DNA, 22 bp, Homo sapiens
acattcttaacagttaaaaact

SEQ ID NO: 10042217 - DNA, 22 bp, Homo sapiens
acagctttttactaatagattg

SEQ ID NO: 10042218 - DNA, 22 bp, Homo sapiens
acagctttatctcagggatcag

SEQ ID NO: 10042219 - DNA, 22 bp, Homo sapiens
acaggcactttgacatgccatc

SEQ ID NO: 10042220 - DNA, 22 bp, Homo sapiens
acaggcacctgccaccacatct

SEQ ID NO: 10042221 - DNA, 22 bp, Homo sapiens
acaggctctggggcaggatggc

SEQ ID NO: 10042222 - DNA, 22 bp, Homo sapiens
agccctgggttagggtgggagc

SEQ ID NO: 10042223 - DNA, 22 bp, Homo sapiens
agcccagctttcacccctctgg

SEQ ID NO: 10042224 - DNA, 19 bp, Homo sapiens
agcatctccctgatcattc

SEQ ID NO: 10042225 - DNA, 22 bp, Homo sapiens
agcattccacactgaagtctgc

SEQ ID NO: 10042226 - DNA, 20 bp, Homo sapiens
agcaggtgacggggcctgct

SEQ ID NO: 10042227 - DNA, 22 bp, Homo sapiens
agcaggagggttttgtagagtc

SEQ ID NO: 10042228 - DNA, 22 bp, Homo sapiens
agcaggagctgtgggaagatgg

SEQ ID NO: 10042229 - DNA, 17 bp, Homo sapiens
agcagctgaagcagcca

SEQ ID NO: 10042230 - DNA, 19 bp, Homo sapiens
agcagccatcgaccatgga

SEQ ID NO: 10042231 - DNA, 22 bp, Homo sapiens
agcagcagcattgagcgcttgt

SEQ ID NO: 10042232 - DNA, 22 bp, Homo sapiens
agcagcagccgtagccttatta

SEQ ID NO: 10042233 - DNA, 21 bp, Homo sapiens
agcagcagcagtggggcttct

SEQ ID NO: 10042234 - DNA, 19 bp, Homo sapiens
agcagcagctaccacttgt

SEQ ID NO: 10042235 - DNA, 19 bp, Homo sapiens
agcagcagcaccagggatt

SEQ ID NO: 10042236 - DNA, 19 bp, Homo sapiens
agcagcagcaccagggatt

SEQ ID NO: 10042237 - DNA, 23 bp, Homo sapiens
agcagcagcaattaagtggatat

SEQ ID NO: 10042238 - DNA, 22 bp, Homo sapiens
agcagcagattatggtctacat

SEQ ID NO: 10042239 - DNA, 22 bp, Homo sapiens
agcagcagttgctgacgttcta

SEQ ID NO: 10042240 - DNA, 22 bp, Homo sapiens
agcagcagctcattcttcctgt

SEQ ID NO: 10042241 - DNA, 22 bp, Homo sapiens
acacactgctcgctcagattaa

SEQ ID NO: 10042242 - DNA, 22 bp, Homo sapiens
agaagttttcattacctataca

SEQ ID NO: 10042243 - DNA, 22 bp, Homo sapiens
agaagttttgggaaatactgat

SEQ ID NO: 10042244 - DNA, 22 bp, Homo sapiens
agaagttttgttgaatgtgtga

SEQ ID NO: 10042245 - DNA, 22 bp, Homo sapiens
agaataaatgttggacttagga

SEQ ID NO: 10042246 - DNA, 22 bp, Homo sapiens
aattcagttggcaaacatgctg

SEQ ID NO: 10042247 - DNA, 22 bp, Homo sapiens
agagcagctgacagcctgccat

SEQ ID NO: 10042248 - DNA, 22 bp, Homo sapiens
agatctgagtggctgcatgtaa

SEQ ID NO: 10042249 - DNA, 22 bp, Homo sapiens
acaaaaaccgtggattcagcat

SEQ ID NO: 10042250 - DNA, 22 bp, Homo sapiens
aacagcttttttggtcagcatt

SEQ ID NO: 10042251 - DNA, 22 bp, Homo sapiens
aacagctttgagcagttctgta

SEQ ID NO: 10042252 - DNA, 22 bp, Homo sapiens
aacaaatgtgttttgtaattaa

SEQ ID NO: 10042253 - DNA, 22 bp, Homo sapiens
aacattctactgtactgcattg

SEQ ID NO: 10042254 - DNA, 22 bp, Homo sapiens
aacattctatgtgcattcagaa

SEQ ID NO: 10042255 - DNA, 22 bp, Homo sapiens
aacattctcattgggatatgtg

SEQ ID NO: 10042256 - DNA, 22 bp, Homo sapiens
aagcagaaaaactgagctccaa

SEQ ID NO: 10042257 - DNA, 22 bp, Homo sapiens
aagcagagttagcttgtcacct

SEQ ID NO: 10042258 - DNA, 22 bp, Homo sapiens
aagcaacattctctgtggcatt

SEQ ID NO: 10042259 - DNA, 22 bp, Homo sapiens
aagaggacagtattcaatatga

SEQ ID NO: 10042260 - DNA, 22 bp, Homo sapiens
aagaggacttgtgaagatgtac

SEQ ID NO: 10042261 - DNA, 22 bp, Homo sapiens
aagacagagactctgcaacagg

SEQ ID NO: 10042262 - DNA, 22 bp, Homo sapiens
aagacagaagtgatttgatgtg

SEQ ID NO: 10042263 - DNA, 22 bp, Homo sapiens
aagacagaccacgtgacagggc

SEQ ID NO: 10042264 - DNA, 22 bp, Homo sapiens
aaagatgtcagtttgaaataac

SEQ ID NO: 10042265 - DNA, 22 bp, Homo sapiens
aaacactgatggatatttttcc

SEQ ID NO: 10042266 - DNA, 22 bp, Homo sapiens
aaaggcccacagtcagtctacc

SEQ ID NO: 10042267 - DNA, 22 bp, Homo sapiens
aaacactgtctctggtattgaa

SEQ ID NO: 10042268 - DNA, 22 bp, Homo sapiens
aaacactgcagggtttacttga

SEQ ID NO: 10042269 - DNA, 22 bp, Homo sapiens
aaacactgcgtggtggcaactc

SEQ ID NO: 10042270 - DNA, 22 bp, Homo sapiens
aaacactgcgtggtggcaactc

SEQ ID NO: 10042271 - DNA, 22 bp, Homo sapiens
aaacactggcaatttcatgcac

SEQ ID NO: 10042272 - DNA, 22 bp, Homo sapiens
aaacactggtatgatgtatagt

SEQ ID NO: 10042273 - DNA, 20 bp, Homo sapiens
aaacactggctggggcacag

SEQ ID NO: 10042274 - DNA, 20 bp, Homo sapiens
aaacactggctggggcacag

SEQ ID NO: 10042275 - DNA, 22 bp, Homo sapiens
aaacactgtacaatctgcaggg

SEQ ID NO: 10042276 - DNA, 22 bp, Homo sapiens
aaacactgtacaatctgcaggg

SEQ ID NO: 10042277 - DNA, 22 bp, Homo sapiens
aaacatctactgtaggctggag

SEQ ID NO: 10042278 - DNA, 22 bp, Homo sapiens
aaacatcataggcatgcatgat

SEQ ID NO: 10042279 - DNA, 22 bp, Homo sapiens
aaacatcaccattttacctaat

SEQ ID NO: 10042280 - DNA, 22 bp, Homo sapiens
aaatattattgcttaaggggag

SEQ ID NO: 10042281 - DNA, 22 bp, Homo sapiens
aaatacagattccagggtctta

SEQ ID NO: 10042282 - DNA, 22 bp, Homo sapiens
aaatactgtgaataaaggtttt

SEQ ID NO: 10042283 - DNA, 23 bp, Homo sapiens
aaactacaacgccaggcactgag

SEQ ID NO: 10042284 - DNA, 23 bp, Homo sapiens
aaactacaacgccaggcactgag

SEQ ID NO: 10042285 - DNA, 22 bp, Homo sapiens
aaactacatctcatggatgagg

SEQ ID NO: 10042286 - DNA, 22 bp, Homo sapiens
aaaagtctgctttctattatca

SEQ ID NO: 10042287 - DNA, 22 bp, Homo sapiens
aaacaaatttcaagctgtgaca

SEQ ID NO: 10042288 - DNA, 22 bp, Homo sapiens
aaacacacagaaatgaatgagg

SEQ ID NO: 10042289 - DNA, 22 bp, Homo sapiens
aaacacaggtactgcagaagtg

SEQ ID NO: 10042290 - DNA, 22 bp, Homo sapiens
aaacatcttgctctgattggta

SEQ ID NO: 10042291 - DNA, 22 bp, Homo sapiens
aaaccacacttagcagtttcgt

SEQ ID NO: 10042292 - DNA, 22 bp, Homo sapiens
aaacatgagttaaaagtaactg

SEQ ID NO: 10042293 - DNA, 22 bp, Homo sapiens
aaacttgggtgaccctgagcaa

SEQ ID NO: 10042294 - DNA, 22 bp, Homo sapiens
aaacttgtgagctaaataaatg

SEQ ID NO: 10042295 - DNA, 20 bp, Homo sapiens
aacactgaggcctactcttc

SEQ ID NO: 10042296 - DNA, 22 bp, Homo sapiens
aacactgagggaaaagagatag

SEQ ID NO: 10042297 - DNA, 20 bp, Homo sapiens
aacactgagggctactcttc

SEQ ID NO: 10042298 - DNA, 22 bp, Homo sapiens
aacactgctccaaaaaaggctt

SEQ ID NO: 10042299 - DNA, 22 bp, Homo sapiens
aagtttctgatattgttaaagc

SEQ ID NO: 10042300 - DNA, 22 bp, Homo sapiens
aagtttctggaccttacctgct

SEQ ID NO: 10042301 - DNA, 22 bp, Homo sapiens
aagtttctgttcgctttaataa

SEQ ID NO: 10042302 - DNA, 22 bp, Homo sapiens
aagtttctgttcatatctctga

SEQ ID NO: 10042303 - DNA, 20 bp, Homo sapiens
aagtttctggtttatatctt

SEQ ID NO: 10042304 - DNA, 22 bp, Homo sapiens
aagtttctgtatgctcttctgt

SEQ ID NO: 10042305 - DNA, 22 bp, Homo sapiens
aatcacatttacattgctaatt

SEQ ID NO: 10042306 - DNA, 22 bp, Homo sapiens
aacattctgtcaattgatgacc

SEQ ID NO: 10042307 - DNA, 22 bp, Homo sapiens
aacattctggttctaaaaacct

SEQ ID NO: 10042308 - DNA, 22 bp, Homo sapiens
aacattcttaagatttgtgtct

SEQ ID NO: 10042309 - DNA, 22 bp, Homo sapiens
aacattcttcaaatatcactct

SEQ ID NO: 10042310 - DNA, 22 bp, Homo sapiens
aacaagttactcttaaagtata

SEQ ID NO: 10042311 - DNA, 22 bp, Homo sapiens
aagggaggaggatttattgtac

SEQ ID NO: 10042312 - DNA, 22 bp, Homo sapiens
aagggaggccagaggttttgca

SEQ ID NO: 10042313 - DNA, 22 bp, Homo sapiens
aaggggcctcacagatgggctt

SEQ ID NO: 10042314 - DNA, 22 bp, Homo sapiens
aacaatgaccacacaatgtact

SEQ ID NO: 10042315 - DNA, 22 bp, Homo sapiens
aaattagtcggtttaggaattt

SEQ ID NO: 10042316 - DNA, 22 bp, Homo sapiens
aaattagtcatgttgtattact

SEQ ID NO: 10042317 - DNA, 22 bp, Homo sapiens
aaattagtgcaccaggttgaag

SEQ ID NO: 10042318 - DNA, 22 bp, Homo sapiens
aaattagtgttttcttactggt

SEQ ID NO: 10042319 - DNA, 22 bp, Homo sapiens
aaattagtacattgcaaagtcc

SEQ ID NO: 10042320 - DNA, 22 bp, Homo sapiens
aagctttgttcttcacagagtg

SEQ ID NO: 10042321 - DNA, 22 bp, Homo sapiens
aagctttgtccaaggccatgca

SEQ ID NO: 10042322 - DNA, 22 bp, Homo sapiens
aagctttgggcagaagaggatt

SEQ ID NO: 10042323 - DNA, 22 bp, Homo sapiens
aagctttgactactgcctcttg

SEQ ID NO: 10042324 - DNA, 22 bp, Homo sapiens
aagctttgcaatgcttcattat

SEQ ID NO: 10042325 - DNA, 22 bp, Homo sapiens
aagctttgataattggattact

SEQ ID NO: 10042326 - DNA, 22 bp, Homo sapiens
aagctttggaagggcagggttg

SEQ ID NO: 10042327 - DNA, 22 bp, Homo sapiens
aagctttgcaccggtggctgga

SEQ ID NO: 10042328 - DNA, 22 bp, Homo sapiens
aagctttggagaggcgggcagg

SEQ ID NO: 10042329 - DNA, 22 bp, Homo sapiens
aagctgtcaatgtatctagtct

SEQ ID NO: 10042330 - DNA, 22 bp, Homo sapiens
aattacttaagagaaactttga

SEQ ID NO: 10042331 - DNA, 22 bp, Homo sapiens
acagagtcatggtagtcaaagg

SEQ ID NO: 10042332 - DNA, 22 bp, Homo sapiens
acagagtcataagcggagctcg

SEQ ID NO: 10042333 - DNA, 22 bp, Homo sapiens
ggatgcaggaggtcggggagca

SEQ ID NO: 10042334 - DNA, 22 bp, Homo sapiens
ggagatggccaaaaacacaaat

SEQ ID NO: 10042335 - DNA, 21 bp, Homo sapiens
ggagatgggtatcgcctgggc

SEQ ID NO: 10042336 - DNA, 22 bp, Homo sapiens
ggcagaaggcaattagagactg

SEQ ID NO: 10042337 - DNA, 22 bp, Homo sapiens
ggcagaaggcctcccagctcct

SEQ ID NO: 10042338 - DNA, 19 bp, Homo sapiens
ggcagaaggtgtaggggga

SEQ ID NO: 10042339 - DNA, 22 bp, Homo sapiens
ggcagaagacaggcaaatcatg

SEQ ID NO: 10042340 - DNA, 22 bp, Homo sapiens
ggcagaagaaaggctaagtctc

SEQ ID NO: 10042341 - DNA, 22 bp, Homo sapiens
ggcagaagataggacagggaat

SEQ ID NO: 10042342 - DNA, 19 bp, Homo sapiens
ggcactggggccaggacca

SEQ ID NO: 10042343 - DNA, 22 bp, Homo sapiens
ggcactgggttgtaggaattaa

SEQ ID NO: 10042344 - DNA, 18 bp, Homo sapiens
ggcactggtgatgcagag

SEQ ID NO: 10042345 - DNA, 22 bp, Homo sapiens
ggcactgggcaccggctgaggg

SEQ ID NO: 10042346 - DNA, 22 bp, Homo sapiens
ggcagcagtaggagctaatctt

SEQ ID NO: 10042347 - DNA, 22 bp, Homo sapiens
ggccctgggccctctagcttgt

SEQ ID NO: 10042348 - DNA, 22 bp, Homo sapiens
ggccctgctcaggctgcgatga

SEQ ID NO: 10042349 - DNA, 22 bp, Homo sapiens
ggcctgcctcacagtcagcacc

SEQ ID NO: 10042350 - DNA, 22 bp, Homo sapiens
ggcatctcgcattcttgtttct

SEQ ID NO: 10042351 - DNA, 22 bp, Homo sapiens
ggcaggagataaaatattagtt

SEQ ID NO: 10042352 - DNA, 22 bp, Homo sapiens
ggcaggagaatggcgtgaactc

SEQ ID NO: 10042353 - DNA, 18 bp, Homo sapiens
ggcaggagcaagaatagg

SEQ ID NO: 10042354 - DNA, 22 bp, Homo sapiens
ggcaggagctcaggttggttcc

SEQ ID NO: 10042355 - DNA, 22 bp, Homo sapiens
ggcaggagctctccagtttgcc

SEQ ID NO: 10042356 - DNA, 22 bp, Homo sapiens
ggcaggaggaagagttagcacc

SEQ ID NO: 10042357 - DNA, 22 bp, Homo sapiens
ggcaggtagcctagaggaggtt

SEQ ID NO: 10042358 - DNA, 22 bp, Homo sapiens
ggcagggtttctccattctgcc

SEQ ID NO: 10042359 - DNA, 18 bp, Homo sapiens
gggcactggggactggag

SEQ ID NO: 10042360 - DNA, 22 bp, Homo sapiens
gggcaggttggcatcccgggca

SEQ ID NO: 10042361 - DNA, 22 bp, Homo sapiens
gggcaggttattggagtaggga

SEQ ID NO: 10042362 - DNA, 23 bp, Homo sapiens
gggcaggtttttataggcttcag

SEQ ID NO: 10042363 - DNA, 21 bp, Homo sapiens
gggcactgaaagggaatagca

SEQ ID NO: 10042364 - DNA, 22 bp, Homo sapiens
gggcactggaggccaaggagct

SEQ ID NO: 10042365 - DNA, 22 bp, Homo sapiens
gggaggtgatggcaagcagcgg

SEQ ID NO: 10042366 - DNA, 22 bp, Homo sapiens
gggagggattagttctgcctgg

SEQ ID NO: 10042367 - DNA, 21 bp, Homo sapiens
gggagggatggaaatgatgtt

SEQ ID NO: 10042368 - DNA, 22 bp, Homo sapiens
gggaggtgattaggaccatgta

SEQ ID NO: 10042369 - DNA, 22 bp, Homo sapiens
gggagggaggtgatgcttggct

SEQ ID NO: 10042370 - DNA, 22 bp, Homo sapiens
gggagggaggtgctggttcacg

SEQ ID NO: 10042371 - DNA, 22 bp, Homo sapiens
gggagggatctgctaggcaatg

SEQ ID NO: 10042372 - DNA, 16 bp, Homo sapiens
gggagggagttggtgg

SEQ ID NO: 10042373 - DNA, 22 bp, Homo sapiens
gggagggagaggacagttctat

SEQ ID NO: 10042374 - DNA, 22 bp, Homo sapiens
gggagggacacaaagagttccc

SEQ ID NO: 10042375 - DNA, 22 bp, Homo sapiens
ggctttgacatgctgaattaaa

SEQ ID NO: 10042376 - DNA, 22 bp, Homo sapiens
ggctgtgcctctggcagcacat

SEQ ID NO: 10042377 - DNA, 22 bp, Homo sapiens
gggagctggagctggaagactc

SEQ ID NO: 10042378 - DNA, 22 bp, Homo sapiens
gggagctgagctggaagagaat

SEQ ID NO: 10042379 - DNA, 22 bp, Homo sapiens
gggaagtgatggagccaggatt

SEQ ID NO: 10042380 - DNA, 22 bp, Homo sapiens
ggctccctgggtgctcctgctc

SEQ ID NO: 10042381 - DNA, 22 bp, Homo sapiens
ggctccagtttgtgccttcagc

SEQ ID NO: 10042382 - DNA, 17 bp, Homo sapiens
ggctccctgactatgga

SEQ ID NO: 10042383 - DNA, 22 bp, Homo sapiens
ggctccctgcaacctccgcctc

SEQ ID NO: 10042384 - DNA, 22 bp, Homo sapiens
ggctccctgcctgtcctcagtc

SEQ ID NO: 10042385 - DNA, 22 bp, Homo sapiens
gtcaagtcatgactcaaaggaa

SEQ ID NO: 10042386 - DNA, 22 bp, Homo sapiens
gtccctggagctgagcagtgct

SEQ ID NO: 10042387 - DNA, 22 bp, Homo sapiens
gtcctctgcccaggtcaaggtt

SEQ ID NO: 10042388 - DNA, 22 bp, Homo sapiens
gtgcccaggggccagctgccgg

SEQ ID NO: 10042389 - DNA, 22 bp, Homo sapiens
gtgcttgcagtgagatgagatg

SEQ ID NO: 10042390 - DNA, 22 bp, Homo sapiens
gtcttctgcaactgcacctgcc

SEQ ID NO: 10042391 - DNA, 22 bp, Homo sapiens
gtcttctgcccaggcagacgga

SEQ ID NO: 10042392 - DNA, 22 bp, Homo sapiens
gtcttctgatctggttagccat

SEQ ID NO: 10042393 - DNA, 22 bp, Homo sapiens
gtgataagacagtaggcacaag

SEQ ID NO: 10042394 - DNA, 22 bp, Homo sapiens
gtgagtcaatgtattgcagcaa

SEQ ID NO: 10042395 - DNA, 22 bp, Homo sapiens
gtcttctgtctgtctggcatgt

SEQ ID NO: 10042396 - DNA, 22 bp, Homo sapiens
gtcttctggaagagagccagct

SEQ ID NO: 10042397 - DNA, 22 bp, Homo sapiens
gtcttctgcctccattagagtt

SEQ ID NO: 10042398 - DNA, 22 bp, Homo sapiens
gtcttctggggccaggcccgct

SEQ ID NO: 10042399 - DNA, 22 bp, Homo sapiens
ggtctttcattacatgggttaa

SEQ ID NO: 10042400 - DNA, 22 bp, Homo sapiens
ggtctttctactgcacttggct

SEQ ID NO: 10042401 - DNA, 22 bp, Homo sapiens
ggtgaagcgtatttgtggagct

SEQ ID NO: 10042402 - DNA, 22 bp, Homo sapiens
ggtgccagagtggcccaggggc

SEQ ID NO: 10042403 - DNA, 22 bp, Homo sapiens
ggtcagccttggatttggtagc

SEQ ID NO: 10042404 - DNA, 22 bp, Homo sapiens
gggtccagagcctcagcccaga

SEQ ID NO: 10042405 - DNA, 22 bp, Homo sapiens
ggtaccaccaattcagctgcca

SEQ ID NO: 10042406 - DNA, 22 bp, Homo sapiens
gggcctgccattgctgccccag

SEQ ID NO: 10042407 - DNA, 22 bp, Homo sapiens
gggcctcagctctgctctgcaa

SEQ ID NO: 10042408 - DNA, 22 bp, Homo sapiens
gggcctccgtgtgctggtgctc

SEQ ID NO: 10042409 - DNA, 22 bp, Homo sapiens
gggctccagcccgggaccaggt

SEQ ID NO: 10042410 - DNA, 22 bp, Homo sapiens
ggggcagctaccggaagtaggg

SEQ ID NO: 10042411 - DNA, 22 bp, Homo sapiens
ggggcacttccaggctgaggct

SEQ ID NO: 10042412 - DNA, 22 bp, Homo sapiens
ggggcaggagcccttcttcagc

SEQ ID NO: 10042413 - DNA, 22 bp, Homo sapiens
gcagtcctcatcctttagcagt

SEQ ID NO: 10042414 - DNA, 22 bp, Homo sapiens
gcagtcctctcattggcctcct

SEQ ID NO: 10042415 - DNA, 22 bp, Homo sapiens
gcatcctggctctaggtgtcat

SEQ ID NO: 10042416 - DNA, 22 bp, Homo sapiens
gccaaggcctctgcaggatgag

SEQ ID NO: 10042417 - DNA, 22 bp, Homo sapiens
gccaagcctgtagacacaagct

SEQ ID NO: 10042418 - DNA, 22 bp, Homo sapiens
gccagcaggtggagagatcaag

SEQ ID NO: 10042419 - DNA, 22 bp, Homo sapiens
gccagcaggttgtcaaggagct

SEQ ID NO: 10042420 - DNA, 22 bp, Homo sapiens
gcccagggcgatggtcggggcc

SEQ ID NO: 10042421 - DNA, 22 bp, Homo sapiens
gcccaggctggagtgcagtggt

SEQ ID NO: 10042422 - DNA, 22 bp, Homo sapiens
gcccatggaaaacctgtcctct

SEQ ID NO: 10042423 - DNA, 23 bp, Homo sapiens
gcccatgctgttgggcccgagca

SEQ ID NO: 10042424 - DNA, 22 bp, Homo sapiens
gcctcagctcccagcccaggct

SEQ ID NO: 10042425 - DNA, 22 bp, Homo sapiens
gcctcagccggcggacgccagg

SEQ ID NO: 10042426 - DNA, 20 bp, Homo sapiens
gcctcagccaacccatgggg

SEQ ID NO: 10042427 - DNA, 22 bp, Homo sapiens
gccagtaaaacaaaggccatgt

SEQ ID NO: 10042428 - DNA, 22 bp, Homo sapiens
gccagtaagtggtagagttgag

SEQ ID NO: 10042429 - DNA, 22 bp, Homo sapiens
gcagcagctcagttctgggagg

SEQ ID NO: 10042430 - DNA, 22 bp, Homo sapiens
gcagcagctcagccgggcactg

SEQ ID NO: 10042431 - DNA, 22 bp, Homo sapiens
gcagcagctcagccgggcactg

SEQ ID NO: 10042432 - DNA, 22 bp, Homo sapiens
gcagcagctccctatccaggct

SEQ ID NO: 10042433 - DNA, 22 bp, Homo sapiens
gcagcagctctcaaagtggtct

SEQ ID NO: 10042434 - DNA, 22 bp, Homo sapiens
gcagcaggtctgtcaatgtcat

SEQ ID NO: 10042435 - DNA, 22 bp, Homo sapiens
gcagcatgttgaaagggccaca

SEQ ID NO: 10042436 - DNA, 22 bp, Homo sapiens
gcagcatcaggttcactgcgtg

SEQ ID NO: 10042437 - DNA, 22 bp, Homo sapiens
gcagcatctagggcactggcct

SEQ ID NO: 10042438 - DNA, 22 bp, Homo sapiens
gcagcatcctgggccacagtcc

SEQ ID NO: 10042439 - DNA, 22 bp, Homo sapiens
gcagggccttagcagcggctgc

SEQ ID NO: 10042440 - DNA, 22 bp, Homo sapiens
gcagggccttggtcatcttttt

SEQ ID NO: 10042441 - DNA, 22 bp, Homo sapiens
gcagggccttagcagcggctgc

SEQ ID NO: 10042442 - DNA, 22 bp, Homo sapiens
gcaggagttaggcgtcgtggat

SEQ ID NO: 10042443 - DNA, 22 bp, Homo sapiens
gcaggagtgacatggatgtgga

SEQ ID NO: 10042444 - DNA, 22 bp, Homo sapiens
gcaggagtggagaccatgggga

SEQ ID NO: 10042445 - DNA, 22 bp, Homo sapiens
gcaggagtgtggtgggacatcc

SEQ ID NO: 10042446 - DNA, 22 bp, Homo sapiens
gcaggaggttgagccaggactg

SEQ ID NO: 10042447 - DNA, 22 bp, Homo sapiens
gcaggagtatgcagctatggtt

SEQ ID NO: 10042448 - DNA, 22 bp, Homo sapiens
gcaggaggagcattaactgagc

SEQ ID NO: 10042449 - DNA, 22 bp, Homo sapiens
gcaggaggatcacttgagccca

SEQ ID NO: 10042450 - DNA, 22 bp, Homo sapiens
gcaggaggccaggtatgcttta

SEQ ID NO: 10042451 - DNA, 22 bp, Homo sapiens
gcaagcttcatatggcattttc

SEQ ID NO: 10042452 - DNA, 20 bp, Homo sapiens
gcaagcttattagtgatatt

SEQ ID NO: 10042453 - DNA, 22 bp, Homo sapiens
gcaagcagttacccaggattcg

SEQ ID NO: 10042454 - DNA, 22 bp, Homo sapiens
gcaagcagacattcaggtaggt

SEQ ID NO: 10042455 - DNA, 22 bp, Homo sapiens
gcactgggagtctgtgggggtt

SEQ ID NO: 10042456 - DNA, 16 bp, Homo sapiens
gcactgggatgtcttc

SEQ ID NO: 10042457 - DNA, 22 bp, Homo sapiens
gcactgggctccaggaaggagg

SEQ ID NO: 10042458 - DNA, 22 bp, Homo sapiens
gcactgggctccaggaaggagg

SEQ ID NO: 10042459 - DNA, 23 bp, Homo sapiens
gcactgggctctcagcaaggtgt

SEQ ID NO: 10042460 - DNA, 22 bp, Homo sapiens
gcactgggaatgctgatgggct

SEQ ID NO: 10042461 - DNA, 22 bp, Homo sapiens
gcactgggaatgtgagcagctg

SEQ ID NO: 10042462 - DNA, 22 bp, Homo sapiens
gcactgggaatgagggcagctt

SEQ ID NO: 10042463 - DNA, 22 bp, Homo sapiens
gcactgggagctgcctgccggt

SEQ ID NO: 10042464 - DNA, 22 bp, Homo sapiens
gcactgggaatgtgagcagctg

SEQ ID NO: 10042465 - DNA, 22 bp, Homo sapiens
gcactgcaggtgggtggagagg

SEQ ID NO: 10042466 - DNA, 22 bp, Homo sapiens
gcactggattttgatctgcaag

SEQ ID NO: 10042467 - DNA, 22 bp, Homo sapiens
gcactgggaagaatgagcctgt

SEQ ID NO: 10042468 - DNA, 22 bp, Homo sapiens
gcactgggaatgagggcagctt

SEQ ID NO: 10042469 - DNA, 22 bp, Homo sapiens
gcactggaaatacctagatgaa

SEQ ID NO: 10042470 - DNA, 22 bp, Homo sapiens
ggagaggagctattgggggctc

SEQ ID NO: 10042471 - DNA, 22 bp, Homo sapiens
ggactgaggacatgtgaggcat

SEQ ID NO: 10042472 - DNA, 18 bp, Homo sapiens
ggacccagggcctcaccc

SEQ ID NO: 10042473 - DNA, 22 bp, Homo sapiens
ggacccaggtagggaggaagat

SEQ ID NO: 10042474 - DNA, 22 bp, Homo sapiens
ggacacgtggctgaaggcggcc

SEQ ID NO: 10042475 - DNA, 22 bp, Homo sapiens
ggacagacaaaaatagtaagca

SEQ ID NO: 10042476 - DNA, 22 bp, Homo sapiens
ggaaaggggcctggatcttttg

SEQ ID NO: 10042477 - DNA, 22 bp, Homo sapiens
ggaaagggcatggccttttcac

SEQ ID NO: 10042478 - DNA, 22 bp, Homo sapiens
ggaaagggagttttgcttatga

SEQ ID NO: 10042479 - DNA, 22 bp, Homo sapiens
gctgtctttcccctgctccaga

SEQ ID NO: 10042480 - DNA, 22 bp, Homo sapiens
gctgtcttgctcactcttgcag

SEQ ID NO: 10042481 - DNA, 22 bp, Homo sapiens
gctgtcttccttgctccaaggg

SEQ ID NO: 10042482 - DNA, 22 bp, Homo sapiens
gctgcagctttaggatccagtg

SEQ ID NO: 10042483 - DNA, 22 bp, Homo sapiens
gctgcacatggcagaggccttt

SEQ ID NO: 10042484 - DNA, 22 bp, Homo sapiens
gctcagctggagagggacgggt

SEQ ID NO: 10042485 - DNA, 22 bp, Homo sapiens
gctcagctgcacctggagagcc

SEQ ID NO: 10042486 - DNA, 22 bp, Homo sapiens
gcctggggcatgcagctgatac

SEQ ID NO: 10042487 - DNA, 22 bp, Homo sapiens
tcagagtctgtgcattctgcta

SEQ ID NO: 10042488 - DNA, 22 bp, Homo sapiens
tcaggcaccctctattttcatc

SEQ ID NO: 10042489 - DNA, 22 bp, Homo sapiens
tcaggcaccccttgagtagggg

SEQ ID NO: 10042490 - DNA, 22 bp, Homo sapiens
tcaggcactggctgagtgatgg

SEQ ID NO: 10042491 - DNA, 22 bp, Homo sapiens
tcatcctgcactggctcctcct

SEQ ID NO: 10042492 - DNA, 22 bp, Homo sapiens
tcaggcctttcttcagagcttc

SEQ ID NO: 10042493 - DNA, 22 bp, Homo sapiens
tcaggcctttgaacttggagtg

SEQ ID NO: 10042494 - DNA, 22 bp, Homo sapiens
tcaggggcagccggggaagcca

SEQ ID NO: 10042495 - DNA, 22 bp, Homo sapiens
tcaggggcttgaggtgcatgtc

SEQ ID NO: 10042496 - DNA, 22 bp, Homo sapiens
tcaggtcccactgctagtaagt

SEQ ID NO: 10042497 - DNA, 22 bp, Homo sapiens
tcacagaatgtctagcataatt

SEQ ID NO: 10042498 - DNA, 22 bp, Homo sapiens
tcaattctagagccttacattg

SEQ ID NO: 10042499 - DNA, 22 bp, Homo sapiens
tcaattctgcatacatttcact

SEQ ID NO: 10042500 - DNA, 22 bp, Homo sapiens
tcaattctagtggagagagttt

SEQ ID NO: 10042501 - DNA, 22 bp, Homo sapiens
tcaaaagtttcacatagagata

SEQ ID NO: 10042502 - DNA, 22 bp, Homo sapiens
tcaaaagtctgcattcttcaca

SEQ ID NO: 10042503 - DNA, 22 bp, Homo sapiens
tcaccttgtgatctccctgcct

SEQ ID NO: 10042504 - DNA, 22 bp, Homo sapiens
tcactgggtaggacatgctgat

SEQ ID NO: 10042505 - DNA, 22 bp, Homo sapiens
tcactggggccatgtgagggac

SEQ ID NO: 10042506 - DNA, 22 bp, Homo sapiens
tcactgggccctgaggtgggac

SEQ ID NO: 10042507 - DNA, 22 bp, Homo sapiens
tcactgggagatgtgggaaggg

SEQ ID NO: 10042508 - DNA, 21 bp, Homo sapiens
tccaccctctctgctcccagt

SEQ ID NO: 10042509 - DNA, 22 bp, Homo sapiens
tccactgcagcttctgatggaa

SEQ ID NO: 10042510 - DNA, 22 bp, Homo sapiens
tccactgctcattccacaggca

SEQ ID NO: 10042511 - DNA, 22 bp, Homo sapiens
tccacacacatttctatgtgca

SEQ ID NO: 10042512 - DNA, 19 bp, Homo sapiens
tccagcctgctgtttctct

SEQ ID NO: 10042513 - DNA, 20 bp, Homo sapiens
tccagccctgcttctctctt

SEQ ID NO: 10042514 - DNA, 21 bp, Homo sapiens
tccagcctttccctcacttcc

SEQ ID NO: 10042515 - DNA, 22 bp, Homo sapiens
tcccagctgtgtggaggagatg

SEQ ID NO: 10042516 - DNA, 22 bp, Homo sapiens
tcccagcctttcttttctgctg

SEQ ID NO: 10042517 - DNA, 20 bp, Homo sapiens
tccaggcccactcagctgaa

SEQ ID NO: 10042518 - DNA, 22 bp, Homo sapiens
tccaggccattgactgcatcct

SEQ ID NO: 10042519 - DNA, 22 bp, Homo sapiens
tccgaggccaaagctgtgaata

SEQ ID NO: 10042520 - DNA, 23 bp, Homo sapiens
tcctccctgacttctacagcaca

SEQ ID NO: 10042521 - DNA, 22 bp, Homo sapiens
tcctccctaaatcctagactgt

SEQ ID NO: 10042522 - DNA, 22 bp, Homo sapiens
tcctccctgggagcttctgagt

SEQ ID NO: 10042523 - DNA, 22 bp, Homo sapiens
tcctcccttgactcctgctttt

SEQ ID NO: 10042524 - DNA, 19 bp, Homo sapiens
tcctccctttggtgtcctg

SEQ ID NO: 10042525 - DNA, 22 bp, Homo sapiens
tccctgcacccttgctgggccc

SEQ ID NO: 10042526 - DNA, 22 bp, Homo sapiens
tccctgcaggtgtgcaagctga

SEQ ID NO: 10042527 - DNA, 22 bp, Homo sapiens
tccctgcagtagtggctaagat

SEQ ID NO: 10042528 - DNA, 22 bp, Homo sapiens
tccctgcagtaggcagccctcc

SEQ ID NO: 10042529 - DNA, 18 bp, Homo sapiens
tcccttctcccttgcctc

SEQ ID NO: 10042530 - DNA, 23 bp, Homo sapiens
tccctgtgtacagcctgcatgag

SEQ ID NO: 10042531 - DNA, 22 bp, Homo sapiens
tatgctaactgggggaaaagag

SEQ ID NO: 10042532 - DNA, 22 bp, Homo sapiens
tatttgtatgtgtgtacatata

SEQ ID NO: 10042533 - DNA, 22 bp, Homo sapiens
tatattatcataaaaccattca

SEQ ID NO: 10042534 - DNA, 22 bp, Homo sapiens
tatctataagtactaacatggt

SEQ ID NO: 10042535 - DNA, 22 bp, Homo sapiens
taggcccagttccgcctcccgg

SEQ ID NO: 10042536 - DNA, 19 bp, Homo sapiens
tagcccagagcctggctac

SEQ ID NO: 10042537 - DNA, 22 bp, Homo sapiens
tagcccagatgattgaaccatg

SEQ ID NO: 10042538 - DNA, 22 bp, Homo sapiens
taggttccatgagggaggcaaa

SEQ ID NO: 10042539 - DNA, 22 bp, Homo sapiens
taggttccatttaaacaaagaa

SEQ ID NO: 10042540 - DNA, 22 bp, Homo sapiens
tagtcaagattggaataatgta

SEQ ID NO: 10042541 - DNA, 21 bp, Homo sapiens
tagcagaaacagttcaggcca

SEQ ID NO: 10042542 - DNA, 22 bp, Homo sapiens
tagcagaaccagcagtcaattt

SEQ ID NO: 10042543 - DNA, 22 bp, Homo sapiens
tagcagaacaatagtcaatgat

SEQ ID NO: 10042544 - DNA, 22 bp, Homo sapiens
tagcagtatggagcgaggccca

SEQ ID NO: 10042545 - DNA, 22 bp, Homo sapiens
tagcagtatattttaaggaagc

SEQ ID NO: 10042546 - DNA, 22 bp, Homo sapiens
tagatgttccacatatatatgt

SEQ ID NO: 10042547 - DNA, 22 bp, Homo sapiens
tactttctaagacatacaactt

SEQ ID NO: 10042548 - DNA, 23 bp, Homo sapiens
gtttctatgtcttgtgccttcat

SEQ ID NO: 10042549 - DNA, 22 bp, Homo sapiens
gtttcctttttctgccctcaat

SEQ ID NO: 10042550 - DNA, 22 bp, Homo sapiens
gtttcctttgccagtaaatggg

SEQ ID NO: 10042551 - DNA, 22 bp, Homo sapiens
gtttccttttggaattagagct

SEQ ID NO: 10042552 - DNA, 22 bp, Homo sapiens
gttccttgtaatttgttaagga

SEQ ID NO: 10042553 - DNA, 22 bp, Homo sapiens
gttccttgtatttcagacatga

SEQ ID NO: 10042554 - DNA, 22 bp, Homo sapiens
gttccttggaagaacttgaggt

SEQ ID NO: 10042555 - DNA, 22 bp, Homo sapiens
gttccttgggaacaacgctgaa

SEQ ID NO: 10042556 - DNA, 23 bp, Homo sapiens
gttccttcatgtggtcattggtt

SEQ ID NO: 10042557 - DNA, 22 bp, Homo sapiens
gttcctggtggtcatggcagct

SEQ ID NO: 10042558 - DNA, 20 bp, Homo sapiens
gttaggaggttggacatgga

SEQ ID NO: 10042559 - DNA, 22 bp, Homo sapiens
gttagagggaaaaatcatttgc

SEQ ID NO: 10042560 - DNA, 22 bp, Homo sapiens
gttagagggctgccttttgttt

SEQ ID NO: 10042561 - DNA, 17 bp, Homo sapiens
taaatacacaagggtat

SEQ ID NO: 10042562 - DNA, 17 bp, Homo sapiens
taaatacacaagggtat

SEQ ID NO: 10042563 - DNA, 22 bp, Homo sapiens
taaatacagtcatttgagccat

SEQ ID NO: 10042564 - DNA, 22 bp, Homo sapiens
taacaatttgcttcatttgttt

SEQ ID NO: 10042565 - DNA, 22 bp, Homo sapiens
tacaggaactgggcaggacatt

SEQ ID NO: 10042566 - DNA, 22 bp, Homo sapiens
tacaggaagtaagtaatgaaat

SEQ ID NO: 10042567 - DNA, 22 bp, Homo sapiens
tacaattactcagctctgctgt

SEQ ID NO: 10042568 - DNA, 22 bp, Homo sapiens
tacacatatgtccattaatcag

SEQ ID NO: 10042569 - DNA, 22 bp, Homo sapiens
tacacatatgtgtgtatatgtg

SEQ ID NO: 10042570 - DNA, 22 bp, Homo sapiens
taagttacctgttttgtcatca

SEQ ID NO: 10042571 - DNA, 22 bp, Homo sapiens
taagcagcgtaaaagccaggga

SEQ ID NO: 10042572 - DNA, 22 bp, Homo sapiens
taagtttctacttgtcgggtct

SEQ ID NO: 10042573 - DNA, 22 bp, Homo sapiens
taagtttctccaaagcacagaa

SEQ ID NO: 10042574 - DNA, 22 bp, Homo sapiens
taagtttccagattgtaagtcc

SEQ ID NO: 10042575 - DNA, 22 bp, Homo sapiens
taatgagaagactttgaggctc

SEQ ID NO: 10042576 - DNA, 21 bp, Homo sapiens
ccttctccacagggtctccgg

SEQ ID NO: 10042577 - DNA, 22 bp, Homo sapiens
ccttctgctccctggccagggc

SEQ ID NO: 10042578 - DNA, 22 bp, Homo sapiens
ttacctgttttacatgcacaac

SEQ ID NO: 10042579 - DNA, 22 bp, Homo sapiens
ttacctgtaaaactgcgatata

SEQ ID NO: 10042580 - DNA, 22 bp, Homo sapiens
ccttgggacagccagcttcaga

SEQ ID NO: 10042581 - DNA, 22 bp, Homo sapiens
cgcactggagctggaacgagtc

SEQ ID NO: 10042582 - DNA, 22 bp, Homo sapiens
tgtttataatatgcagtgagca

SEQ ID NO: 10042583 - DNA, 22 bp, Homo sapiens
tgttgctactctccctgggagg

SEQ ID NO: 10042584 - DNA, 22 bp, Homo sapiens
tgttgctaaggggaatgagagc

SEQ ID NO: 10042585 - DNA, 22 bp, Homo sapiens
tggttagactcaccttatagtt

SEQ ID NO: 10042586 - DNA, 22 bp, Homo sapiens
tggttagaggcttcttgcttgg

SEQ ID NO: 10042587 - DNA, 22 bp, Homo sapiens
tggttagatgaggctggtttca

SEQ ID NO: 10042588 - DNA, 22 bp, Homo sapiens
cctgtaggcgagggatggacag

SEQ ID NO: 10042589 - DNA, 22 bp, Homo sapiens
ttaaaatccagtgttggtggat

SEQ ID NO: 10042590 - DNA, 22 bp, Homo sapiens
cctgtgcttcagctggaggagg

SEQ ID NO: 10042591 - DNA, 22 bp, Homo sapiens
ttacaatagttccttcttttgt

SEQ ID NO: 10042592 - DNA, 22 bp, Homo sapiens
ttcttaagtttagcaacttgtg

SEQ ID NO: 10042593 - DNA, 20 bp, Homo sapiens
ttcttaaagacctcactttg

SEQ ID NO: 10042594 - DNA, 22 bp, Homo sapiens
ttcttaaagaggcaaaacacag

SEQ ID NO: 10042595 - DNA, 22 bp, Homo sapiens
ttgcaaaaaccacaattacttt

SEQ ID NO: 10042596 - DNA, 22 bp, Homo sapiens
ttgcaaaaactgcaattacttt

SEQ ID NO: 10042597 - DNA, 22 bp, Homo sapiens
ttgcaaaagccgaggcactcca

SEQ ID NO: 10042598 - DNA, 22 bp, Homo sapiens
ctcagcagtatactctgaagat

SEQ ID NO: 10042599 - DNA, 22 bp, Homo sapiens
ctcagcagtgacaagagagtat

SEQ ID NO: 10042600 - DNA, 22 bp, Homo sapiens
ctcaggcccacagcagacccac

SEQ ID NO: 10042601 - DNA, 22 bp, Homo sapiens
ctcaggcctgagtggcagtccc

SEQ ID NO: 10042602 - DNA, 22 bp, Homo sapiens
ctcaggccattcttccagctgc

SEQ ID NO: 10042603 - DNA, 22 bp, Homo sapiens
ctcaggccaggtttctcccaca

SEQ ID NO: 10042604 - DNA, 22 bp, Homo sapiens
ctcaggccattcctaccaaggg

SEQ ID NO: 10042605 - DNA, 22 bp, Homo sapiens
ctcaggccaataagctccagcc

SEQ ID NO: 10042606 - DNA, 22 bp, Homo sapiens
ttgcactgtaagcatctgtgtc

SEQ ID NO: 10042607 - DNA, 23 bp, Homo sapiens
ttgcactgatcaatttgataagc

SEQ ID NO: 10042608 - DNA, 18 bp, Homo sapiens
ctcaggcctttccctgtg

SEQ ID NO: 10042609 - DNA, 22 bp, Homo sapiens
ctcaggccttgaagtcttttct

SEQ ID NO: 10042610 - DNA, 22 bp, Homo sapiens
cgcagcagccccgtggtaggtg

SEQ ID NO: 10042611 - DNA, 19 bp, Homo sapiens
ttctcattcctttccactt

SEQ ID NO: 10042612 - DNA, 22 bp, Homo sapiens
ctaaccatcttacaaatgtctg

SEQ ID NO: 10042613 - DNA, 22 bp, Homo sapiens
ctgagatctttatacgaggcac

SEQ ID NO: 10042614 - DNA, 22 bp, Homo sapiens
ctgagaggtgacagcgtgctgg

SEQ ID NO: 10042615 - DNA, 22 bp, Homo sapiens
ctgagaggtgctggtggctgca

SEQ ID NO: 10042616 - DNA, 22 bp, Homo sapiens
ctgagaggtaagcagcgcagtg

SEQ ID NO: 10042617 - DNA, 22 bp, Homo sapiens
ctgagaggggaccagggtgttt

SEQ ID NO: 10042618 - DNA, 22 bp, Homo sapiens
ctgagaggggaccagggtgttt

SEQ ID NO: 10042619 - DNA, 22 bp, Homo sapiens
ctgagaggtaagcagcgcagtg

SEQ ID NO: 10042620 - DNA, 22 bp, Homo sapiens
ctgagaggtgacagcgtgctgg

SEQ ID NO: 10042621 - DNA, 22 bp, Homo sapiens
ctgaaggattagagagcactta

SEQ ID NO: 10042622 - DNA, 22 bp, Homo sapiens
ttttcctggggcttctggactc

SEQ ID NO: 10042623 - DNA, 22 bp, Homo sapiens
ttttctctatattgtctgtgaa

SEQ ID NO: 10042624 - DNA, 22 bp, Homo sapiens
ctgctcctgtgggccagtggcc

SEQ ID NO: 10042625 - DNA, 21 bp, Homo sapiens
ctgctgctggggtctgggcag

SEQ ID NO: 10042626 - DNA, 22 bp, Homo sapiens
ctgcctctgttgggcatggtct

SEQ ID NO: 10042627 - DNA, 22 bp, Homo sapiens
ctgcctcttgacagatcgtggc

SEQ ID NO: 10042628 - DNA, 22 bp, Homo sapiens
ctgcctctggttttggtccctg

SEQ ID NO: 10042629 - DNA, 22 bp, Homo sapiens
ctgcctctggcctcaggcccag

SEQ ID NO: 10042630 - DNA, 22 bp, Homo sapiens
ctgccctgagtcatgccagatg

SEQ ID NO: 10042631 - DNA, 22 bp, Homo sapiens
tttatatatggctggtctggat

SEQ ID NO: 10042632 - DNA, 22 bp, Homo sapiens
ctccccacatttctccctgtct

SEQ ID NO: 10042633 - DNA, 22 bp, Homo sapiens
ctccccaccttcgcggtccctg

SEQ ID NO: 10042634 - DNA, 22 bp, Homo sapiens
ctccctggaggtgagctggcac

SEQ ID NO: 10042635 - DNA, 22 bp, Homo sapiens
ctccctgggcagatgtggctct

SEQ ID NO: 10042636 - DNA, 22 bp, Homo sapiens
ctccctggcagccgcactcctg

SEQ ID NO: 10042637 - DNA, 22 bp, Homo sapiens
ctccctgtgtcttcacttggcc

SEQ ID NO: 10042638 - DNA, 22 bp, Homo sapiens
ctccctggtgtcccctccagga

SEQ ID NO: 10042639 - DNA, 22 bp, Homo sapiens
ctccctggtctttcccatcatt

SEQ ID NO: 10042640 - DNA, 22 bp, Homo sapiens
ctctggagcatttcacctacat

SEQ ID NO: 10042641 - DNA, 19 bp, Homo sapiens
ctctggagtcattgctccc

SEQ ID NO: 10042642 - DNA, 22 bp, Homo sapiens
tttcttcttgatttaaacaggg

SEQ ID NO: 10042643 - DNA, 22 bp, Homo sapiens
tttcttaaatatttgcaggaca

SEQ ID NO: 10042644 - DNA, 22 bp, Homo sapiens
tttctgtttagcataaagtggc

SEQ ID NO: 10042645 - DNA, 22 bp, Homo sapiens
tttctgtttagcataaagtggc

SEQ ID NO: 10042646 - DNA, 22 bp, Homo sapiens
tttctgttgtacttaaactagg

SEQ ID NO: 10042647 - DNA, 22 bp, Homo sapiens
ctctctggcacttcattgctgt

SEQ ID NO: 10042648 - DNA, 22 bp, Homo sapiens
gacagcagcataatacatgaac

SEQ ID NO: 10042649 - DNA, 22 bp, Homo sapiens
gacattctaaaaaatatggaag

SEQ ID NO: 10042650 - DNA, 22 bp, Homo sapiens
gacagcaagagacagagcatcc

SEQ ID NO: 10042651 - DNA, 18 bp, Homo sapiens
gagagggatccctcagga

SEQ ID NO: 10042652 - DNA, 21 bp, Homo sapiens
gagagggcattataggaagtg

SEQ ID NO: 10042653 - DNA, 22 bp, Homo sapiens
gagagggctgcctggtgtgagg

SEQ ID NO: 10042654 - DNA, 22 bp, Homo sapiens
gaatgacattgaaaagacattg

SEQ ID NO: 10042655 - DNA, 22 bp, Homo sapiens
gaagcaagtgcaaggaagaggc

SEQ ID NO: 10042656 - DNA, 22 bp, Homo sapiens
gaaggcaccctccatcactcac

SEQ ID NO: 10042657 - DNA, 22 bp, Homo sapiens
gaaggcccagcttgaatgctgc

SEQ ID NO: 10042658 - DNA, 22 bp, Homo sapiens
gaggaaatcattccagaaaagg

SEQ ID NO: 10042659 - DNA, 18 bp, Homo sapiens
gagcatgggcagtgggga

SEQ ID NO: 10042660 - DNA, 22 bp, Homo sapiens
gagcagtggtggtgtgttagag

SEQ ID NO: 10042661 - DNA, 22 bp, Homo sapiens
gagcccaggttctgcttccagc

SEQ ID NO: 10042662 - DNA, 22 bp, Homo sapiens
gagcccagctgcggccctcagc

SEQ ID NO: 10042663 - DNA, 22 bp, Homo sapiens
gagcccagctctacctcagact

SEQ ID NO: 10042664 - DNA, 22 bp, Homo sapiens
gagcccagctgtccttggcaaa

SEQ ID NO: 10042665 - DNA, 22 bp, Homo sapiens
gagggaggtgatactgaacgta

SEQ ID NO: 10042666 - DNA, 22 bp, Homo sapiens
gagggaggtgatactgaacgta

SEQ ID NO: 10042667 - DNA, 22 bp, Homo sapiens
gagggagtgccagagggccagc

SEQ ID NO: 10042668 - DNA, 22 bp, Homo sapiens
gagggaggcatcatgaatccag

SEQ ID NO: 10042669 - DNA, 22 bp, Homo sapiens
gagggagcttgatggatgtttg

SEQ ID NO: 10042670 - DNA, 22 bp, Homo sapiens
gagggagggactagcattctct

SEQ ID NO: 10042671 - DNA, 22 bp, Homo sapiens
gagggagggactagcattctct

SEQ ID NO: 10042672 - DNA, 22 bp, Homo sapiens
gagggagggaaagtttaacact

SEQ ID NO: 10042673 - DNA, 22 bp, Homo sapiens
gagggagggccaggtcccaacc

SEQ ID NO: 10042674 - DNA, 22 bp, Homo sapiens
gagggaggggagctccaccctc

SEQ ID NO: 10042675 - DNA, 22 bp, Homo sapiens
gaggagcacatgaggctgaggg

SEQ ID NO: 10042676 - DNA, 22 bp, Homo sapiens
gaggagcatgggaaggctctgg

SEQ ID NO: 10042677 - DNA, 22 bp, Homo sapiens
gaggagcccccactgggctcac

SEQ ID NO: 10042678 - DNA, 22 bp, Homo sapiens
cttctcagaggccagaagctat

SEQ ID NO: 10042679 - DNA, 22 bp, Homo sapiens
cttccaatagcaacaaagatta

SEQ ID NO: 10042680 - DNA, 22 bp, Homo sapiens
cttcctgggtctggagactgga

SEQ ID NO: 10042681 - DNA, 22 bp, Homo sapiens
cttagctagaggcaattatgtt

SEQ ID NO: 10042682 - DNA, 22 bp, Homo sapiens
cttaaattggatgagttaagtt

SEQ ID NO: 10042683 - DNA, 22 bp, Homo sapiens
cttaaattttcatctacaagaa

SEQ ID NO: 10042684 - DNA, 22 bp, Homo sapiens
cttacaaaggagaggagatagg

SEQ ID NO: 10042685 - DNA, 22 bp, Homo sapiens
cttacaaatacacttaggagag

SEQ ID NO: 10042686 - DNA, 22 bp, Homo sapiens
ctgttttctagggctgaggtga

SEQ ID NO: 10042687 - DNA, 22 bp, Homo sapiens
gaaacacatgcagctccataga

SEQ ID NO: 10042688 - DNA, 22 bp, Homo sapiens
cttttctgtatcaaaaggatta

SEQ ID NO: 10042689 - DNA, 22 bp, Homo sapiens
ctttgcagtgaatccataaata

SEQ ID NO: 10042690 - DNA, 22 bp, Homo sapiens
ctttgcagtatagcctagtaga

SEQ ID NO: 10042691 - DNA, 22 bp, Homo sapiens
ctttgcagttagcctaggattg

SEQ ID NO: 10042692 - DNA, 23 bp, Homo sapiens
cttctggctctatatcagaattc

SEQ ID NO: 10042693 - DNA, 22 bp, Homo sapiens
cttctggaggacactggcccca

SEQ ID NO: 10042694 - DNA, 22 bp, Homo sapiens
cttctggagctcaccaacttcc

SEQ ID NO: 10042695 - DNA, 22 bp, Homo sapiens
cttctggcaaaacaggcagaaa

SEQ ID NO: 10042696 - DNA, 22 bp, Homo sapiens
ctttacaaactataaagtgcgg

SEQ ID NO: 10042697 - DNA, 22 bp, Homo sapiens
ctttacaaagcaattttgtctc

SEQ ID NO: 10042698 - DNA, 22 bp, Homo sapiens
ctttgaaaaatggtttcctaga

SEQ ID NO: 10042699 - DNA, 22 bp, Homo sapiens
ctttctttgtccaccaacaatg

SEQ ID NO: 10042700 - DNA, 17 bp, Homo sapiens
ctgggatgtggactctt

SEQ ID NO: 10042701 - DNA, 22 bp, Homo sapiens
ctgggagcgcagcaggcacaac

SEQ ID NO: 10042702 - DNA, 22 bp, Homo sapiens
ctgggagcaagtcaggaaaggt

SEQ ID NO: 10042703 - DNA, 22 bp, Homo sapiens
ctgggcctccagctctgccagc

SEQ ID NO: 10042704 - DNA, 22 bp, Homo sapiens
ctgggaagaagtgggctacatt

SEQ ID NO: 10042705 - DNA, 22 bp, Homo sapiens
ctgtgccctctttgctggcctt

SEQ ID NO: 10042706 - DNA, 22 bp, Homo sapiens
tacagcatgtccttagcaaggc

SEQ ID NO: 10042707 - DNA, 17 bp, Homo sapiens
caggccttgagccttta

SEQ ID NO: 10042708 - DNA, 22 bp, Homo sapiens
caggccttgaaggcctgcggga

SEQ ID NO: 10042709 - DNA, 22 bp, Homo sapiens
caggccttctccctccctcaac

SEQ ID NO: 10042710 - DNA, 22 bp, Homo sapiens
caggccttagtaggtgctccct

SEQ ID NO: 10042711 - DNA, 22 bp, Homo sapiens
caggccttatctccaccctgca

SEQ ID NO: 10042712 - DNA, 22 bp, Homo sapiens
caggccttgggacccagactgg

SEQ ID NO: 10042713 - DNA, 22 bp, Homo sapiens
caggccttgcgtcccatggcct

SEQ ID NO: 10042714 - DNA, 22 bp, Homo sapiens
caggccttgagttttgggcttt

SEQ ID NO: 10042715 - DNA, 22 bp, Homo sapiens
caggccttaaggactcggagaa

SEQ ID NO: 10042716 - DNA, 22 bp, Homo sapiens
tacagctgagtttaggtacagg

SEQ ID NO: 10042717 - DNA, 22 bp, Homo sapiens
cagctctgccatcatctgcctt

SEQ ID NO: 10042718 - DNA, 22 bp, Homo sapiens
tacactgagcaggaagaagtgg

SEQ ID NO: 10042719 - DNA, 22 bp, Homo sapiens
cagggcagttttacttctctct

SEQ ID NO: 10042720 - DNA, 22 bp, Homo sapiens
cagggagggaggaaaatttgct

SEQ ID NO: 10042721 - DNA, 22 bp, Homo sapiens
cagggagggacaattgtcacct

SEQ ID NO: 10042722 - DNA, 22 bp, Homo sapiens
cagggaggatgggctgttttgc

SEQ ID NO: 10042723 - DNA, 23 bp, Homo sapiens
cagggaggagatactgtgtatct

SEQ ID NO: 10042724 - DNA, 22 bp, Homo sapiens
cagggaggctgtcttatgcctg

SEQ ID NO: 10042725 - DNA, 22 bp, Homo sapiens
cagtggcagagccgttgccatc

SEQ ID NO: 10042726 - DNA, 17 bp, Homo sapiens
cagtggcagatcttctc

SEQ ID NO: 10042727 - DNA, 17 bp, Homo sapiens
cagtggcagatcttctc

SEQ ID NO: 10042728 - DNA, 22 bp, Homo sapiens
tcactgcagacaacctcagtca

SEQ ID NO: 10042729 - DNA, 22 bp, Homo sapiens
cagtggcacatggaccttgtca

SEQ ID NO: 10042730 - DNA, 22 bp, Homo sapiens
tcactgcagcctctgcctcccg

SEQ ID NO: 10042731 - DNA, 22 bp, Homo sapiens
tcactgcaagctccacctcccg

SEQ ID NO: 10042732 - DNA, 22 bp, Homo sapiens
tcactgcaacctctgcctcccg

SEQ ID NO: 10042733 - DNA, 22 bp, Homo sapiens
tcactgcaacctccacctcctg

SEQ ID NO: 10042734 - DNA, 22 bp, Homo sapiens
cagtggcaagaacagtaataat

SEQ ID NO: 10042735 - DNA, 22 bp, Homo sapiens
cagtggcaagtccggtattgaa

SEQ ID NO: 10042736 - DNA, 22 bp, Homo sapiens
cagtggcaaggacagtaataat

SEQ ID NO: 10042737 - DNA, 22 bp, Homo sapiens
cagtggcaagtccggtattgaa

SEQ ID NO: 10042738 - DNA, 22 bp, Homo sapiens
cagtagcaggcactcagcacgt

SEQ ID NO: 10042739 - DNA, 22 bp, Homo sapiens
cagtcttttgtatattagcaga

SEQ ID NO: 10042740 - DNA, 22 bp, Homo sapiens
cagtctttgttcccattactga

SEQ ID NO: 10042741 - DNA, 22 bp, Homo sapiens
tcaaattatttaggatagtgct

SEQ ID NO: 10042742 - DNA, 22 bp, Homo sapiens
tcaaattagtggaataataatg

SEQ ID NO: 10042743 - DNA, 22 bp, Homo sapiens
tatatagaaaagcagatgttgg

SEQ ID NO: 10042744 - DNA, 22 bp, Homo sapiens
catcgtatggccgaatgtacat

SEQ ID NO: 10042745 - DNA, 22 bp, Homo sapiens
tcatacaactaagagtttcaga

SEQ ID NO: 10042746 - DNA, 22 bp, Homo sapiens
catcagtggatatagattagcg

SEQ ID NO: 10042747 - DNA, 22 bp, Homo sapiens
catcagtgaaagtgaatgttct

SEQ ID NO: 10042748 - DNA, 22 bp, Homo sapiens
catcagtgagccccttgatgag

SEQ ID NO: 10042749 - DNA, 22 bp, Homo sapiens
catcagtgcccttggggatgcc

SEQ ID NO: 10042750 - DNA, 22 bp, Homo sapiens
catgctctctggcaacttgtgt

SEQ ID NO: 10042751 - DNA, 22 bp, Homo sapiens
tccagcagaaccagagacctgg

SEQ ID NO: 10042752 - DNA, 22 bp, Homo sapiens
tccagcagaaaagaggtaggga

SEQ ID NO: 10042753 - DNA, 22 bp, Homo sapiens
catgtgcattggggccagggag

SEQ ID NO: 10042754 - DNA, 22 bp, Homo sapiens
catgtgggaagaggccagctgg

SEQ ID NO: 10042755 - DNA, 22 bp, Homo sapiens
tccatataatgggattccttat

SEQ ID NO: 10042756 - DNA, 22 bp, Homo sapiens
tccatatacaacttaatcttta

SEQ ID NO: 10042757 - DNA, 22 bp, Homo sapiens
tccatacatacagatatgcatt

SEQ ID NO: 10042758 - DNA, 22 bp, Homo sapiens
tccatacatatccaaagagaag

SEQ ID NO: 10042759 - DNA, 22 bp, Homo sapiens
ccaaccacgaaaccaaggtggc

SEQ ID NO: 10042760 - DNA, 20 bp, Homo sapiens
tcctggccttctcgggcagt

SEQ ID NO: 10042761 - DNA, 21 bp, Homo sapiens
ccacaggggctcccctgtcag

SEQ ID NO: 10042762 - DNA, 22 bp, Homo sapiens
ccacagggcctttcctgctggc

SEQ ID NO: 10042763 - DNA, 22 bp, Homo sapiens
ccacagggaacatgacagcctt

SEQ ID NO: 10042764 - DNA, 20 bp, Homo sapiens
ccaccctgctaagaatacac

SEQ ID NO: 10042765 - DNA, 20 bp, Homo sapiens
ccaccctccaggaacacata

SEQ ID NO: 10042766 - DNA, 22 bp, Homo sapiens
ccagaggctgggttcacctcag

SEQ ID NO: 10042767 - DNA, 22 bp, Homo sapiens
tggagaattctatgttgagggg

SEQ ID NO: 10042768 - DNA, 22 bp, Homo sapiens
tggagacatgggcgaatctaag

SEQ ID NO: 10042769 - DNA, 22 bp, Homo sapiens
ccctccctttgcagcagtgcat

SEQ ID NO: 10042770 - DNA, 22 bp, Homo sapiens
ccctccctgaagaagttactct

SEQ ID NO: 10042771 - DNA, 22 bp, Homo sapiens
ccctggaggaagaaacaatggc

SEQ ID NO: 10042772 - DNA, 22 bp, Homo sapiens
tggaggagaactccctggctac

SEQ ID NO: 10042773 - DNA, 22 bp, Homo sapiens
ccctggagtgccggaatcaaga

SEQ ID NO: 10042774 - DNA, 22 bp, Homo sapiens
ccctggagtccggagctcacct

SEQ ID NO: 10042775 - DNA, 22 bp, Homo sapiens
ccctggaggtcagaggcctggg

SEQ ID NO: 10042776 - DNA, 22 bp, Homo sapiens
ccctggagtgtgacgaggcatt

SEQ ID NO: 10042777 - DNA, 22 bp, Homo sapiens
tggcagaagtacacaagcatgc

SEQ ID NO: 10042778 - DNA, 22 bp, Homo sapiens
ccctgggacccgctgcagaggc

SEQ ID NO: 10042779 - DNA, 22 bp, Homo sapiens
tgcttccctgctctgcacacct

SEQ ID NO: 10042780 - DNA, 22 bp, Homo sapiens
ccctccctatgtagatgatgtt

SEQ ID NO: 10042781 - DNA, 22 bp, Homo sapiens
tgcttgctgggtcttgcatctg

SEQ ID NO: 10042782 - DNA, 22 bp, Homo sapiens
tgcttgctgtaaagcttggtca

SEQ ID NO: 10042783 - DNA, 22 bp, Homo sapiens
tgcttgcttgaggcgagacatt

SEQ ID NO: 10042784 - DNA, 22 bp, Homo sapiens
tgcttgcttctcacatgcacct

SEQ ID NO: 10042785 - DNA, 22 bp, Homo sapiens
tgcttgcttcagccctcatctt

SEQ ID NO: 10042786 - DNA, 22 bp, Homo sapiens
tgcttgctggaggcagacagaa

SEQ ID NO: 10042787 - DNA, 22 bp, Homo sapiens
tgcttgctgggccaatggcaat

SEQ ID NO: 10042788 - DNA, 22 bp, Homo sapiens
tgcttggctagcttggcagctc

SEQ ID NO: 10042789 - DNA, 22 bp, Homo sapiens
tgcttggctaaaaatggcaaga

SEQ ID NO: 10042790 - DNA, 19 bp, Homo sapiens
cccagtctaggtcctagga

SEQ ID NO: 10042791 - DNA, 19 bp, Homo sapiens
tgctaatcaagaaaacctt

SEQ ID NO: 10042792 - DNA, 22 bp, Homo sapiens
tgcaggtgctccgggggtgccc

SEQ ID NO: 10042793 - DNA, 22 bp, Homo sapiens
tgctaggggtcagcaccatatc

SEQ ID NO: 10042794 - DNA, 22 bp, Homo sapiens
tgctaggggcactaaaagctga

SEQ ID NO: 10042795 - DNA, 22 bp, Homo sapiens
tgggcagacattgagtttgttc

SEQ ID NO: 10042796 - DNA, 22 bp, Homo sapiens
cctctcccacgtggcagaggct

SEQ ID NO: 10042797 - DNA, 19 bp, Homo sapiens
cctctcccatgcttacctc

SEQ ID NO: 10042798 - DNA, 22 bp, Homo sapiens
cctctcccagggagagcctgag

SEQ ID NO: 10042799 - DNA, 22 bp, Homo sapiens
tggcagtgtgggaggaaggtac

SEQ ID NO: 10042800 - DNA, 21 bp, Homo sapiens
tgggcctcaagtgggtggcag

SEQ ID NO: 10042801 - DNA, 22 bp, Homo sapiens
tgggcaggcaagtgaatacctt

SEQ ID NO: 10042802 - DNA, 22 bp, Homo sapiens
cctgcctgcaccttctctgggg

SEQ ID NO: 10042803 - DNA, 22 bp, Homo sapiens
tggttagacacatgcatgtcat

SEQ ID NO: 10042804 - DNA, 22 bp, Homo sapiens
tgcaaatattgggacagtctag

SEQ ID NO: 10042805 - DNA, 22 bp, Homo sapiens
cccaagccagaccctgaccctg

SEQ ID NO: 10042806 - DNA, 18 bp, Homo sapiens
tgcactagatgctggcag

SEQ ID NO: 10042807 - DNA, 22 bp, Homo sapiens
tgcactggtggtgagtgaggga

SEQ ID NO: 10042808 - DNA, 22 bp, Homo sapiens
tgcactgggaaagaaggaggga

SEQ ID NO: 10042809 - DNA, 22 bp, Homo sapiens
tgcactggggtcccagcgcacg

SEQ ID NO: 10042810 - DNA, 22 bp, Homo sapiens
tgagtccatagtggatccttca

SEQ ID NO: 10042811 - DNA, 22 bp, Homo sapiens
ccatccagaccagtccatgggt

SEQ ID NO: 10042812 - DNA, 22 bp, Homo sapiens
ccatccctgggccatgtcccct

SEQ ID NO: 10042813 - DNA, 22 bp, Homo sapiens
tgagcaggggagagcgaatgtg

SEQ ID NO: 10042814 - DNA, 22 bp, Homo sapiens
tgagccatgggactccaaggga

SEQ ID NO: 10042815 - DNA, 22 bp, Homo sapiens
ccaggcacttgtttgccaggca

SEQ ID NO: 10042816 - DNA, 22 bp, Homo sapiens
tctgggccctaaaccagctcta

SEQ ID NO: 10042817 - DNA, 22 bp, Homo sapiens
ccaggagcaggagctgcagctg

SEQ ID NO: 10042818 - DNA, 22 bp, Homo sapiens
ccaggagcagggctggctgcac

SEQ ID NO: 10042819 - DNA, 22 bp, Homo sapiens
tttggtaaatgcaggttcttct

SEQ ID NO: 10042820 - DNA, 22 bp, Homo sapiens
tttgggcatatagctgttccct

SEQ ID NO: 10042821 - DNA, 20 bp, Homo sapiens
tttgagaccagtctgcccaa

SEQ ID NO: 10042822 - DNA, 22 bp, Homo sapiens
tttgcttgattaggatatggaa

SEQ ID NO: 10042823 - DNA, 22 bp, Homo sapiens
tttgaagacagatcaatataag

SEQ ID NO: 10042824 - DNA, 22 bp, Homo sapiens
tttgaagacatattgttacata

SEQ ID NO: 10042825 - DNA, 22 bp, Homo sapiens
tttgagaaggtgacaaattcta

SEQ ID NO: 10042826 - DNA, 19 bp, Homo sapiens
ttttccttctatatgtttc

SEQ ID NO: 10042827 - DNA, 18 bp, Homo sapiens
ttttccttccaccttgaa

SEQ ID NO: 10042828 - DNA, 22 bp, Homo sapiens
ttttccttctagagcagatttc

SEQ ID NO: 10042829 - DNA, 22 bp, Homo sapiens
ttttccttcatatcccttatgt

SEQ ID NO: 10042830 - DNA, 22 bp, Homo sapiens
ttttccttcacctcttgagcct

SEQ ID NO: 10042831 - DNA, 22 bp, Homo sapiens
ttttccttaacagagggagaaa

SEQ ID NO: 10042832 - DNA, 22 bp, Homo sapiens
ttttccttagcttctctgcgag

SEQ ID NO: 10042833 - DNA, 22 bp, Homo sapiens
ttcaaaagtaatcagtattaga

SEQ ID NO: 10042834 - DNA, 22 bp, Homo sapiens
ttcaaaagactcagatgtagcg

SEQ ID NO: 10042835 - DNA, 22 bp, Homo sapiens
ttatttaattttctcactcaga

SEQ ID NO: 10042836 - DNA, 22 bp, Homo sapiens
ttatttaaaagtggtaagattc

SEQ ID NO: 10042837 - DNA, 22 bp, Homo sapiens
ttatttaaaatgtaggttggga

SEQ ID NO: 10042838 - DNA, 22 bp, Homo sapiens
ttatttaatgtgatctgaagag

SEQ ID NO: 10042839 - DNA, 22 bp, Homo sapiens
ttatgcaaggacttattacagt

SEQ ID NO: 10042840 - DNA, 22 bp, Homo sapiens
ttatggaatttgcaaaaggtta

SEQ ID NO: 10042841 - DNA, 22 bp, Homo sapiens
ttatggaatggagaaagtctgc

SEQ ID NO: 10042842 - DNA, 22 bp, Homo sapiens
ttatggaagtgcaaattgtgtg

SEQ ID NO: 10042843 - DNA, 22 bp, Homo sapiens
tcctctggcccagctgcctctg

SEQ ID NO: 10042844 - DNA, 22 bp, Homo sapiens
tcctctgctccatctttactgt

SEQ ID NO: 10042845 - DNA, 21 bp, Homo sapiens
tcctctgctctcataccacaa

SEQ ID NO: 10042846 - DNA, 22 bp, Homo sapiens
tcctctgctgttctggttcttt

SEQ ID NO: 10042847 - DNA, 22 bp, Homo sapiens
tcctctggatataagcctcacc

SEQ ID NO: 10042848 - DNA, 22 bp, Homo sapiens
tcctctgccaaagggagttgcc

SEQ ID NO: 10042849 - DNA, 22 bp, Homo sapiens
tcctctgccccagatgaaattt

SEQ ID NO: 10042850 - DNA, 22 bp, Homo sapiens
tcctctccagcaaactggctat

SEQ ID NO: 10042851 - DNA, 22 bp, Homo sapiens
ttcatacatgtgtactgttcca

SEQ ID NO: 10042852 - DNA, 23 bp, Homo sapiens
ttcatacagaaacatcacttcat

SEQ ID NO: 10042853 - DNA, 22 bp, Homo sapiens
ttcaaggttcagggagaaattg

SEQ ID NO: 10042854 - DNA, 22 bp, Homo sapiens
ttgagaggctgttgacattctg

SEQ ID NO: 10042855 - DNA, 22 bp, Homo sapiens
ttctttggaataagtcaagctg

SEQ ID NO: 10042856 - DNA, 23 bp, Homo sapiens
ttctttggaattgggctgcaagg

SEQ ID NO: 10042857 - DNA, 22 bp, Homo sapiens
ttctttggcatttcctgtatgt

SEQ ID NO: 10042858 - DNA, 22 bp, Homo sapiens
ttctttggggtctccagcatag

SEQ ID NO: 10042859 - DNA, 22 bp, Homo sapiens
ttctttggggaatattctggtt

SEQ ID NO: 10042860 - DNA, 22 bp, Homo sapiens
ttctttgggctcagagagggag

SEQ ID NO: 10042861 - DNA, 22 bp, Homo sapiens
ttctttggcttacgtctggcct

SEQ ID NO: 10042862 - DNA, 22 bp, Homo sapiens
ttctttggctgccagtctggag

SEQ ID NO: 10042863 - DNA, 22 bp, Homo sapiens
ttctttgggattgtagctgtct

SEQ ID NO: 10042864 - DNA, 22 bp, Homo sapiens
ttctttgggcaattgctggccc

SEQ ID NO: 10042865 - DNA, 22 bp, Homo sapiens
ttctttctcactctttaggaag

SEQ ID NO: 10042866 - DNA, 22 bp, Homo sapiens
ttcttcctctgtaaaaggtgac

SEQ ID NO: 10042867 - DNA, 22 bp, Homo sapiens
ttctggatataacattcagtcc

SEQ ID NO: 10042868 - DNA, 22 bp, Homo sapiens
ttctcagagcactgctgacaaa

SEQ ID NO: 10042869 - DNA, 22 bp, Homo sapiens
ttctcttagctgtaaagtcaat

SEQ ID NO: 10042870 - DNA, 22 bp, Homo sapiens
ttctgcagcatgaggctggagc

SEQ ID NO: 10042871 - DNA, 22 bp, Homo sapiens
ttctgcacattttagcaaagta

SEQ ID NO: 10042872 - DNA, 22 bp, Homo sapiens
tttccttgcacattggtttcca

SEQ ID NO: 10042873 - DNA, 22 bp, Homo sapiens
tttcctttgagggtcctacact

SEQ ID NO: 10042874 - DNA, 23 bp, Homo sapiens
tttatttatttaggctgagggat

SEQ ID NO: 10042875 - DNA, 22 bp, Homo sapiens
tttatttatccttctggattgc

SEQ ID NO: 10042876 - DNA, 21 bp, Homo sapiens
tttatttatataggacacatg

SEQ ID NO: 10042877 - DNA, 22 bp, Homo sapiens
tttatttataagccacttgctg

SEQ ID NO: 10042878 - DNA, 22 bp, Homo sapiens
ttgtgcagctataaagaaatgg

SEQ ID NO: 10042879 - DNA, 22 bp, Homo sapiens
ttgggctgatctgtggaagaag

SEQ ID NO: 10042880 - DNA, 22 bp, Homo sapiens
ttggcccactctcagaatgtgg

SEQ ID NO: 10042881 - DNA, 22 bp, Homo sapiens
ttggcccagactcggggactga

SEQ ID NO: 10042882 - DNA, 22 bp, Homo sapiens
ttggcccagcatgcgggtctgt

SEQ ID NO: 10042883 - DNA, 22 bp, Homo sapiens
ttggcccagggtcagcggcgct

SEQ ID NO: 10042884 - DNA, 22 bp, Homo sapiens
ttgcccagagtcacccagctca

SEQ ID NO: 10042885 - DNA, 22 bp, Homo sapiens
ttgctaagttatagagtatctt

SEQ ID NO: 10042886 - DNA, 19 bp, Homo sapiens
ttgctaaatggaaaagcac

SEQ ID NO: 10042887 - DNA, 22 bp, Homo sapiens
ttgctaaaaggtgaaaagtgta

SEQ ID NO: 10042888 - DNA, 22 bp, Homo sapiens
ttgctaaatccctataatattc

SEQ ID NO: 10042889 - DNA, 22 bp, Homo sapiens
ttgctaaaaatggaattatagg

SEQ ID NO: 10042890 - DNA, 22 bp, Homo sapiens
ttggaagtaatgaagaggtggg

SEQ ID NO: 10042891 - DNA, 22 bp, Homo sapiens
ttggcaaaatttaaagaagtga

SEQ ID NO: 10042892 - DNA, 22 bp, Homo sapiens
ttggcacacagtaagccctaag

SEQ ID NO: 10042893 - DNA, 22 bp, Homo sapiens
ttggaacatgccggggtccagg

SEQ ID NO: 10042894 - DNA, 23 bp, Homo sapiens
ttgcttctgtgcaattcagtact

SEQ ID NO: 10042895 - DNA, 22 bp, Homo sapiens
ttgcttgcagacttagcaaatt

SEQ ID NO: 10042896 - DNA, 22 bp, Homo sapiens
ttgcttgcataatgctggcatg

SEQ ID NO: 10042897 - DNA, 22 bp, Homo sapiens
ttgcttgcattgtccctggtga

SEQ ID NO: 10042898 - DNA, 22 bp, Homo sapiens
ttgcttgcctgttaggagaaac

SEQ ID NO: 10042899 - DNA, 22 bp, Homo sapiens
ttgcttgccctgcagcatactt

SEQ ID NO: 10042900 - DNA, 22 bp, Homo sapiens
ttgcttgcccaagtgtcaattt

SEQ ID NO: 10042901 - DNA, 22 bp, Homo sapiens
ttgcttgcttctattttataca

SEQ ID NO: 10042902 - DNA, 22 bp, Homo sapiens
ttgcttgctcaactctgttgtt

SEQ ID NO: 10042903 - DNA, 22 bp, Homo sapiens
ttgcttgctatccagatcagtc

SEQ ID NO: 10042904 - DNA, 23 bp, Homo sapiens
ttgcttgcctttagtcaggacca

SEQ ID NO: 10042905 - DNA, 22 bp, Homo sapiens
ttgcttgcttcttgggagtggt

SEQ ID NO: 10042906 - DNA, 22 bp, Homo sapiens
ccatctccaaataccatcacat

SEQ ID NO: 10042907 - DNA, 18 bp, Homo sapiens
cccagcctctcctttcta

SEQ ID NO: 10042908 - DNA, 22 bp, Homo sapiens
ccccattctggccagcccagct

SEQ ID NO: 10042909 - DNA, 22 bp, Homo sapiens
ccccagggaagctttgcttact

SEQ ID NO: 10042910 - DNA, 22 bp, Homo sapiens
ccccagggactggtttcatgga

SEQ ID NO: 10042911 - DNA, 22 bp, Homo sapiens
ccccagggtcagtgtgtggagg

SEQ ID NO: 10042912 - DNA, 19 bp, Homo sapiens
ccccagggtaggctagggg

SEQ ID NO: 10042913 - DNA, 22 bp, Homo sapiens
agggagcatgggtgaagcaggc

SEQ ID NO: 10042914 - DNA, 22 bp, Homo sapiens
agggagccagagttgggagctc

SEQ ID NO: 10042915 - DNA, 22 bp, Homo sapiens
agggagcaaaggtttcagggtt

SEQ ID NO: 10042916 - DNA, 22 bp, Homo sapiens
agggagcagcagccacaggatg

SEQ ID NO: 10042917 - DNA, 18 bp, Homo sapiens
agggagcatctggttgcc

SEQ ID NO: 10042918 - DNA, 18 bp, Homo sapiens
agggagcatctggttgcc

SEQ ID NO: 10042919 - DNA, 22 bp, Homo sapiens
agggagcagggctcctttgggt

SEQ ID NO: 10042920 - DNA, 22 bp, Homo sapiens
agggagcagggctcctttgggt

SEQ ID NO: 10042921 - DNA, 22 bp, Homo sapiens
cctcaaattgtcaaataagaat

SEQ ID NO: 10042922 - DNA, 22 bp, Homo sapiens
agggcagcattgcctttctcca

SEQ ID NO: 10042923 - DNA, 22 bp, Homo sapiens
agggcagcagctgtccctgaga

SEQ ID NO: 10042924 - DNA, 22 bp, Homo sapiens
agggcagcagctcctcctagct

SEQ ID NO: 10042925 - DNA, 22 bp, Homo sapiens
agggaggagtcctcaaagtcat

SEQ ID NO: 10042926 - DNA, 22 bp, Homo sapiens
agggcagctaaggtgctgactg

SEQ ID NO: 10042927 - DNA, 22 bp, Homo sapiens
agggcagcctgagtgctggccc

SEQ ID NO: 10042928 - DNA, 22 bp, Homo sapiens
agggcagcggtgcttgtgttat

SEQ ID NO: 10042929 - DNA, 22 bp, Homo sapiens
agggcagcccttctgggagggc

SEQ ID NO: 10042930 - DNA, 22 bp, Homo sapiens
agggcagcctctcagcctaggt

SEQ ID NO: 10042931 - DNA, 22 bp, Homo sapiens
agggcagctctcacctctggcc

SEQ ID NO: 10042932 - DNA, 22 bp, Homo sapiens
agggcagctctcacctctggcc

SEQ ID NO: 10042933 - DNA, 22 bp, Homo sapiens
ccaggcacttcatcattagggt

SEQ ID NO: 10042934 - DNA, 22 bp, Homo sapiens
aggcctcctggctccaggcctt

SEQ ID NO: 10042935 - DNA, 22 bp, Homo sapiens
aggcctcagctcagtgtgacag

SEQ ID NO: 10042936 - DNA, 17 bp, Homo sapiens
aggcctccctccaggcc

SEQ ID NO: 10042937 - DNA, 22 bp, Homo sapiens
ccaggctctgagaggaatgtga

SEQ ID NO: 10042938 - DNA, 22 bp, Homo sapiens
aggccctgaagtcggcccctca

SEQ ID NO: 10042939 - DNA, 22 bp, Homo sapiens
aggcccatgtgagtcttgtcct

SEQ ID NO: 10042940 - DNA, 22 bp, Homo sapiens
aggcccatagtagctctgggca

SEQ ID NO: 10042941 - DNA, 22 bp, Homo sapiens
aggcccagttatcctacttgtt

SEQ ID NO: 10042942 - DNA, 22 bp, Homo sapiens
aggcccagttatcctacttgtt

SEQ ID NO: 10042943 - DNA, 22 bp, Homo sapiens
aggcccagtgtggcttcctgga

SEQ ID NO: 10042944 - DNA, 22 bp, Homo sapiens
aggcccagtgtggcttcctgga

SEQ ID NO: 10042945 - DNA, 22 bp, Homo sapiens
aggcccatgttcacttgctcag

SEQ ID NO: 10042946 - DNA, 20 bp, Homo sapiens
aggcccagtgaatatattgc

SEQ ID NO: 10042947 - DNA, 22 bp, Homo sapiens
aggcccagtgccattagttttg

SEQ ID NO: 10042948 - DNA, 22 bp, Homo sapiens
aggcccagtcctctgccgtctg

SEQ ID NO: 10042949 - DNA, 22 bp, Homo sapiens
aggcccagtagtgctgccttta

SEQ ID NO: 10042950 - DNA, 22 bp, Homo sapiens
aggcccagctggacaaactgct

SEQ ID NO: 10042951 - DNA, 22 bp, Homo sapiens
aggcccagtagtcgacggcgct

SEQ ID NO: 10042952 - DNA, 22 bp, Homo sapiens
aggccaagtgctgggacaggtg

SEQ ID NO: 10042953 - DNA, 19 bp, Homo sapiens
ccactggggctccacatta

SEQ ID NO: 10042954 - DNA, 22 bp, Homo sapiens
aggcagtggctgagaccagggg

SEQ ID NO: 10042955 - DNA, 22 bp, Homo sapiens
aggcagtggagctggaataggc

SEQ ID NO: 10042956 - DNA, 22 bp, Homo sapiens
aggcaggttggtgagaagactg

SEQ ID NO: 10042957 - DNA, 23 bp, Homo sapiens
aggcaggtttgggctcttcttgt

SEQ ID NO: 10042958 - DNA, 22 bp, Homo sapiens
agcttgctgtattttctggagg

SEQ ID NO: 10042959 - DNA, 22 bp, Homo sapiens
aggaaaggcctttgcatttggt

SEQ ID NO: 10042960 - DNA, 22 bp, Homo sapiens
cagggccagagagggctggctg

SEQ ID NO: 10042961 - DNA, 22 bp, Homo sapiens
cagggccactgtagatgaggag

SEQ ID NO: 10042962 - DNA, 22 bp, Homo sapiens
caggaggttgtaagagcaggcc

SEQ ID NO: 10042963 - DNA, 22 bp, Homo sapiens
cagcttctgtttctagcccctg

SEQ ID NO: 10042964 - DNA, 22 bp, Homo sapiens
cagcttctggcgtggagcctga

SEQ ID NO: 10042965 - DNA, 21 bp, Homo sapiens
cagcttcttctgtgacctggt

SEQ ID NO: 10042966 - DNA, 22 bp, Homo sapiens
cagctctgaagaaaggtgtcta

SEQ ID NO: 10042967 - DNA, 22 bp, Homo sapiens
cagctttgtgcaatgcagtctc

SEQ ID NO: 10042968 - DNA, 22 bp, Homo sapiens
cagctttgtggccttgacctcg

SEQ ID NO: 10042969 - DNA, 22 bp, Homo sapiens
cagctttgtgacttcggacaag

SEQ ID NO: 10042970 - DNA, 22 bp, Homo sapiens
cagctttgtctgattcctcttt

SEQ ID NO: 10042971 - DNA, 21 bp, Homo sapiens
cagctttgtctgtcttcgggg

SEQ ID NO: 10042972 - DNA, 16 bp, Homo sapiens
cagctttgtctcctcg

SEQ ID NO: 10042973 - DNA, 22 bp, Homo sapiens
cagctttgtcatttgatttggg

SEQ ID NO: 10042974 - DNA, 22 bp, Homo sapiens
cagctttgtcctgcaaacctga

SEQ ID NO: 10042975 - DNA, 22 bp, Homo sapiens
cagctttggagtgtgagtgctg

SEQ ID NO: 10042976 - DNA, 22 bp, Homo sapiens
cagctttggcccagtcgggagg

SEQ ID NO: 10042977 - DNA, 22 bp, Homo sapiens
cagctttgattctttctgccat

SEQ ID NO: 10042978 - DNA, 22 bp, Homo sapiens
cagctttgcaggctggtcagtg

SEQ ID NO: 10042979 - DNA, 22 bp, Homo sapiens
cagctttgccaagtaaggtctt

SEQ ID NO: 10042980 - DNA, 22 bp, Homo sapiens
cagctttgccctttgcccaatc

SEQ ID NO: 10042981 - DNA, 19 bp, Homo sapiens
aggcagcacccagtccttg

SEQ ID NO: 10042982 - DNA, 18 bp, Homo sapiens
cattccccatctctgagc

SEQ ID NO: 10042983 - DNA, 22 bp, Homo sapiens
catggccccaaatcccatgcat

SEQ ID NO: 10042984 - DNA, 22 bp, Homo sapiens
catggccagggcagatggcagg

SEQ ID NO: 10042985 - DNA, 19 bp, Homo sapiens
aggcagcattctggggctt

SEQ ID NO: 10042986 - DNA, 22 bp, Homo sapiens
aggcagcatttgaatccaggtc

SEQ ID NO: 10042987 - DNA, 22 bp, Homo sapiens
aggcagcagccacaaggcctga

SEQ ID NO: 10042988 - DNA, 22 bp, Homo sapiens
aggagaggcatcaagaaaatcg

SEQ ID NO: 10042989 - DNA, 22 bp, Homo sapiens
aggagaggctctaactctgtgt

SEQ ID NO: 10042990 - DNA, 19 bp, Homo sapiens
aggaaggaacctgagtctg

SEQ ID NO: 10042991 - DNA, 22 bp, Homo sapiens
ctctccccacaccctctgcatg

SEQ ID NO: 10042992 - DNA, 23 bp, Homo sapiens
ctccttggtatgccatgcccagc

SEQ ID NO: 10042993 - DNA, 22 bp, Homo sapiens
ctcctgcatgctcacatatgcc

SEQ ID NO: 10042994 - DNA, 22 bp, Homo sapiens
ctctggagaacgctatggatct

SEQ ID NO: 10042995 - DNA, 22 bp, Homo sapiens
agtggctttttagtggcagatg

SEQ ID NO: 10042996 - DNA, 22 bp, Homo sapiens
agtggcttggctgcactacagg

SEQ ID NO: 10042997 - DNA, 22 bp, Homo sapiens
agtggcttatctgggacagcta

SEQ ID NO: 10042998 - DNA, 22 bp, Homo sapiens
agtggtggagccaggaaatgtg

SEQ ID NO: 10042999 - DNA, 22 bp, Homo sapiens
ctcttagtaatgccatgaagca

SEQ ID NO: 10043000 - DNA, 22 bp, Homo sapiens
ctcttgcttgcaagtggggata

SEQ ID NO: 10043001 - DNA, 16 bp, Homo sapiens
ctctttggcttccaag

SEQ ID NO: 10043002 - DNA, 22 bp, Homo sapiens
ctctttggctttgactcccatt

SEQ ID NO: 10043003 - DNA, 22 bp, Homo sapiens
ctctttggcgttggcagagcca

SEQ ID NO: 10043004 - DNA, 22 bp, Homo sapiens
ctcagcctgtgaagagcagagg

SEQ ID NO: 10043005 - DNA, 22 bp, Homo sapiens
agtgacagctgggaaggtgaaa

SEQ ID NO: 10043006 - DNA, 21 bp, Homo sapiens
agtgacagaggaaggtgcata

SEQ ID NO: 10043007 - DNA, 22 bp, Homo sapiens
agtgacaggggaggcaggtgtg

SEQ ID NO: 10043008 - DNA, 22 bp, Homo sapiens
agtgacagggaaggataggatt

SEQ ID NO: 10043009 - DNA, 22 bp, Homo sapiens
ctcaaatatgtggtcagaaagc

SEQ ID NO: 10043010 - DNA, 21 bp, Homo sapiens
ctcaaatgccagttttattta

SEQ ID NO: 10043011 - DNA, 22 bp, Homo sapiens
cctgggaagttgtggctgcagt

SEQ ID NO: 10043012 - DNA, 17 bp, Homo sapiens
aggtgccagtgatatac

SEQ ID NO: 10043013 - DNA, 22 bp, Homo sapiens
aggtgccagctctcaggcagga

SEQ ID NO: 10043014 - DNA, 22 bp, Homo sapiens
ccttgctcaagctagtgacggg

SEQ ID NO: 10043015 - DNA, 22 bp, Homo sapiens
ccttggccctagcctcaggcaa

SEQ ID NO: 10043016 - DNA, 22 bp, Homo sapiens
cctggcagcgtgccgagctgcg

SEQ ID NO: 10043017 - DNA, 22 bp, Homo sapiens
cctggcagcgccgaagctggcc

SEQ ID NO: 10043018 - DNA, 19 bp, Homo sapiens
cctggccagacttctgccc

SEQ ID NO: 10043019 - DNA, 22 bp, Homo sapiens
cctggccacccagccttggcca

SEQ ID NO: 10043020 - DNA, 21 bp, Homo sapiens
cctggccaatctgatagggtt

SEQ ID NO: 10043021 - DNA, 22 bp, Homo sapiens
cctggccacagggctctgcatt

SEQ ID NO: 10043022 - DNA, 22 bp, Homo sapiens
cctggcagctgtttggcttggc

SEQ ID NO: 10043023 - DNA, 22 bp, Homo sapiens
cctggccagaggcgtgcctgtg

SEQ ID NO: 10043024 - DNA, 22 bp, Homo sapiens
cctgggaaggtcttagcatcta

SEQ ID NO: 10043025 - DNA, 22 bp, Homo sapiens
cctgggaaggtgaggccctgga

SEQ ID NO: 10043026 - DNA, 22 bp, Homo sapiens
cctctgcaaagaatttgtctcc

SEQ ID NO: 10043027 - DNA, 22 bp, Homo sapiens
cctctgcatctggctgctgcag

SEQ ID NO: 10043028 - DNA, 22 bp, Homo sapiens
cctctgcatgtgcagtaccgag

SEQ ID NO: 10043029 - DNA, 22 bp, Homo sapiens
cctctgcagcagagagccagag

SEQ ID NO: 10043030 - DNA, 22 bp, Homo sapiens
cctctgcaccatagccttcagc

SEQ ID NO: 10043031 - DNA, 22 bp, Homo sapiens
agggtgaatctcacaactctta

SEQ ID NO: 10043032 - DNA, 22 bp, Homo sapiens
ctgggcaggatacttcatggga

SEQ ID NO: 10043033 - DNA, 22 bp, Homo sapiens
ctgggcaggatacttcatggga

SEQ ID NO: 10043034 - DNA, 22 bp, Homo sapiens
atatggcattacattgttaaat

SEQ ID NO: 10043035 - DNA, 22 bp, Homo sapiens
atatatatgctgatggctgcca

SEQ ID NO: 10043036 - DNA, 22 bp, Homo sapiens
atatatattgcccaggctggtt

SEQ ID NO: 10043037 - DNA, 22 bp, Homo sapiens
atatatatcgagttcatgtctc

SEQ ID NO: 10043038 - DNA, 22 bp, Homo sapiens
atcctctctgttttcgtgtatg

SEQ ID NO: 10043039 - DNA, 22 bp, Homo sapiens
atccaaaggtgacacagaatac

SEQ ID NO: 10043040 - DNA, 22 bp, Homo sapiens
agtttggaagagaaaaatattt

SEQ ID NO: 10043041 - DNA, 22 bp, Homo sapiens
ataaaagtaggaccaacttaca

SEQ ID NO: 10043042 - DNA, 22 bp, Homo sapiens
agttggagtgaacatgagattg

SEQ ID NO: 10043043 - DNA, 22 bp, Homo sapiens
agttgctttggatataacttct

SEQ ID NO: 10043044 - DNA, 18 bp, Homo sapiens
agttgcttattctgtgca

SEQ ID NO: 10043045 - DNA, 22 bp, Homo sapiens
agttgcttccctattcttagca

SEQ ID NO: 10043046 - DNA, 22 bp, Homo sapiens
agttgggattcttggttctggg

SEQ ID NO: 10043047 - DNA, 22 bp, Homo sapiens
agttgggagttatagactctat

SEQ ID NO: 10043048 - DNA, 22 bp, Homo sapiens
agttggcacatagcaaattcgc

SEQ ID NO: 10043049 - DNA, 21 bp, Homo sapiens
ctctttgggatctttggaaag

SEQ ID NO: 10043050 - DNA, 22 bp, Homo sapiens
ctctttgggatgggctctgctg

SEQ ID NO: 10043051 - DNA, 16 bp, Homo sapiens
ctctttgggcttccag

SEQ ID NO: 10043052 - DNA, 22 bp, Homo sapiens
ctctttggtcgcatcatccatt

SEQ ID NO: 10043053 - DNA, 22 bp, Homo sapiens
ctctttggggtgccccactggt

SEQ ID NO: 10043054 - DNA, 22 bp, Homo sapiens
ctctttggggctggaagcctag

SEQ ID NO: 10043055 - DNA, 22 bp, Homo sapiens
ggttccttctgaggtccctgta

SEQ ID NO: 10043056 - DNA, 19 bp, Homo sapiens
ggttcctcacgctaagggc

SEQ ID NO: 10043057 - DNA, 22 bp, Homo sapiens
cagcaagggataaacaaggacg

SEQ ID NO: 10043058 - DNA, 22 bp, Homo sapiens
cagcaaggtctgtcaatagtgg

SEQ ID NO: 10043059 - DNA, 22 bp, Homo sapiens
cagcaagggttatatcaaagat

SEQ ID NO: 10043060 - DNA, 22 bp, Homo sapiens
cagcaagggataaagagttact

SEQ ID NO: 10043061 - DNA, 22 bp, Homo sapiens
cagcaaggccattggatgcagt

SEQ ID NO: 10043062 - DNA, 22 bp, Homo sapiens
cagcaaggcattctgtggatta

SEQ ID NO: 10043063 - DNA, 22 bp, Homo sapiens
gtatcttttggtggaaaaataa

SEQ ID NO: 10043064 - DNA, 22 bp, Homo sapiens
gtatatgtgtgggcctgcatat

SEQ ID NO: 10043065 - DNA, 22 bp, Homo sapiens
cagcagcaaggtgagggtggag

SEQ ID NO: 10043066 - DNA, 22 bp, Homo sapiens
cagcagcaacaacggaagcctt

SEQ ID NO: 10043067 - DNA, 22 bp, Homo sapiens
cagcagcaacaacggaagcctt

SEQ ID NO: 10043068 - DNA, 22 bp, Homo sapiens
cagcagagtaattctcacctct

SEQ ID NO: 10043069 - DNA, 22 bp, Homo sapiens
cagcagagtatggcactcaact

SEQ ID NO: 10043070 - DNA, 22 bp, Homo sapiens
cactgggacctaggactgagct

SEQ ID NO: 10043071 - DNA, 22 bp, Homo sapiens
cagaagcagtgagagatgtgca

SEQ ID NO: 10043072 - DNA, 22 bp, Homo sapiens
cagaaggcaaggcctgccacgc

SEQ ID NO: 10043073 - DNA, 22 bp, Homo sapiens
cagaaggtgaaggcagaacctt

SEQ ID NO: 10043074 - DNA, 22 bp, Homo sapiens
cagaagtctttctgtttcacct

SEQ ID NO: 10043075 - DNA, 18 bp, Homo sapiens
cagaagtccttcaaggcc

SEQ ID NO: 10043076 - DNA, 22 bp, Homo sapiens
gggagcaggagcctgcctgcca

SEQ ID NO: 10043077 - DNA, 22 bp, Homo sapiens
gggagcaggacataatagcaat

SEQ ID NO: 10043078 - DNA, 19 bp, Homo sapiens
gggagcaggaaagctgtgg

SEQ ID NO: 10043079 - DNA, 22 bp, Homo sapiens
gggagcagcctgcctcccacct

SEQ ID NO: 10043080 - DNA, 22 bp, Homo sapiens
cagaagttttgctctcttgggt

SEQ ID NO: 10043081 - DNA, 22 bp, Homo sapiens
cagaagttggagctttccatca

SEQ ID NO: 10043082 - DNA, 22 bp, Homo sapiens
cagaagttagtgtctgccagta

SEQ ID NO: 10043083 - DNA, 22 bp, Homo sapiens
gggacttaatgcagagagggac

SEQ ID NO: 10043084 - DNA, 22 bp, Homo sapiens
cagaagtggatattagagtaat

SEQ ID NO: 10043085 - DNA, 22 bp, Homo sapiens
cagaagtgcaatttaaattagg

SEQ ID NO: 10043086 - DNA, 22 bp, Homo sapiens
cagaagtggtattaattagatt

SEQ ID NO: 10043087 - DNA, 22 bp, Homo sapiens
gggagcagttaaaatgattcct

SEQ ID NO: 10043088 - DNA, 22 bp, Homo sapiens
gggcactgtgttcagagtgcag

SEQ ID NO: 10043089 - DNA, 22 bp, Homo sapiens
gggcactgtgctgggtgcttta

SEQ ID NO: 10043090 - DNA, 22 bp, Homo sapiens
gggccttctagttagccccaat

SEQ ID NO: 10043091 - DNA, 22 bp, Homo sapiens
gggccttcagccttggactgag

SEQ ID NO: 10043092 - DNA, 22 bp, Homo sapiens
gggccttccgactcccaaggcc

SEQ ID NO: 10043093 - DNA, 22 bp, Homo sapiens
cagagcctgctgccttctgaag

SEQ ID NO: 10043094 - DNA, 22 bp, Homo sapiens
cagaggcctcacttccagccag

SEQ ID NO: 10043095 - DNA, 22 bp, Homo sapiens
cagaggccacctgtggccactg

SEQ ID NO: 10043096 - DNA, 22 bp, Homo sapiens
cagaggccaggctgcctgactg

SEQ ID NO: 10043097 - DNA, 22 bp, Homo sapiens
cagaggccagggggctcacaaa

SEQ ID NO: 10043098 - DNA, 22 bp, Homo sapiens
cagaggtggggagtatttcaag

SEQ ID NO: 10043099 - DNA, 22 bp, Homo sapiens
gggtgccacagagcttccactt

SEQ ID NO: 10043100 - DNA, 22 bp, Homo sapiens
ggagggagtttcattcctgccc

SEQ ID NO: 10043101 - DNA, 22 bp, Homo sapiens
ggagggagtcagctgattagaa

SEQ ID NO: 10043102 - DNA, 22 bp, Homo sapiens
ggagggagcagagaacccaacc

SEQ ID NO: 10043103 - DNA, 22 bp, Homo sapiens
ggagggagcatccccttgctga

SEQ ID NO: 10043104 - DNA, 22 bp, Homo sapiens
ggagggagggctagaccaaaga

SEQ ID NO: 10043105 - DNA, 22 bp, Homo sapiens
ggagggaggttagattcaagct

SEQ ID NO: 10043106 - DNA, 22 bp, Homo sapiens
ggagggaggttagattcaagct

SEQ ID NO: 10043107 - DNA, 22 bp, Homo sapiens
cacactgataggcttgacaggc

SEQ ID NO: 10043108 - DNA, 22 bp, Homo sapiens
cacactgccacattcactcttc

SEQ ID NO: 10043109 - DNA, 22 bp, Homo sapiens
ggcagagctctggactgagaac

SEQ ID NO: 10043110 - DNA, 22 bp, Homo sapiens
ggcagcatccgcccggcaccct

SEQ ID NO: 10043111 - DNA, 22 bp, Homo sapiens
ggcagcatctctggcagcagct

SEQ ID NO: 10043112 - DNA, 22 bp, Homo sapiens
ggcagcatgtgtggtccgctgg

SEQ ID NO: 10043113 - DNA, 22 bp, Homo sapiens
ggcactgggaatgcagtgatga

SEQ ID NO: 10043114 - DNA, 22 bp, Homo sapiens
ggcactgggagaggtgagacgg

SEQ ID NO: 10043115 - DNA, 22 bp, Homo sapiens
ggcactggaagtcccattgtct

SEQ ID NO: 10043116 - DNA, 22 bp, Homo sapiens
ggcactggaaggatcatgtgag

SEQ ID NO: 10043117 - DNA, 22 bp, Homo sapiens
ggcactggagactgttatgaga

SEQ ID NO: 10043118 - DNA, 16 bp, Homo sapiens
ggcactggcaggtcct

SEQ ID NO: 10043119 - DNA, 22 bp, Homo sapiens
ggcactggcaaagcaaagtctg

SEQ ID NO: 10043120 - DNA, 20 bp, Homo sapiens
ggcactggaagcacacagga

SEQ ID NO: 10043121 - DNA, 22 bp, Homo sapiens
caccatctggtaggcattagtg

SEQ ID NO: 10043122 - DNA, 22 bp, Homo sapiens
caccctggctggaggtgcagtg

SEQ ID NO: 10043123 - DNA, 22 bp, Homo sapiens
cacccctgtggagcatggtggc

SEQ ID NO: 10043124 - DNA, 22 bp, Homo sapiens
cacccaggctagagtgcagtgg

SEQ ID NO: 10043125 - DNA, 22 bp, Homo sapiens
cacccaggttggagtgcagtgg

SEQ ID NO: 10043126 - DNA, 22 bp, Homo sapiens
cactgagcagtggtgaaaatct

SEQ ID NO: 10043127 - DNA, 22 bp, Homo sapiens
cactgagccaggagcaatatca

SEQ ID NO: 10043128 - DNA, 22 bp, Homo sapiens
cactgactccaaaaataaagaa

SEQ ID NO: 10043129 - DNA, 22 bp, Homo sapiens
cacacagtgggaaaacctgaag

SEQ ID NO: 10043130 - DNA, 22 bp, Homo sapiens
cacacattgagcagctgtttgt

SEQ ID NO: 10043131 - DNA, 23 bp, Homo sapiens
cacaccaggagccgtctgggcca

SEQ ID NO: 10043132 - DNA, 22 bp, Homo sapiens
cacaccagatggcagcgtggga

SEQ ID NO: 10043133 - DNA, 22 bp, Homo sapiens
cacaaagtgttagatgccactc

SEQ ID NO: 10043134 - DNA, 22 bp, Homo sapiens
gcttctccagaccttcatcccc

SEQ ID NO: 10043135 - DNA, 22 bp, Homo sapiens
gcttctcctcccgctcccaggc

SEQ ID NO: 10043136 - DNA, 22 bp, Homo sapiens
caaggcagctattgtctccata

SEQ ID NO: 10043137 - DNA, 22 bp, Homo sapiens
caaggaggaagatgcaggggac

SEQ ID NO: 10043138 - DNA, 22 bp, Homo sapiens
caacctctatcggtcaggaagc

SEQ ID NO: 10043139 - DNA, 22 bp, Homo sapiens
caacactgattatggctgagct

SEQ ID NO: 10043140 - DNA, 21 bp, Homo sapiens
gctgcatcaatctacccaggg

SEQ ID NO: 10043141 - DNA, 22 bp, Homo sapiens
caacagtgattctgcatgagga

SEQ ID NO: 10043142 - DNA, 22 bp, Homo sapiens
caacatcagtcctcatgagaca

SEQ ID NO: 10043143 - DNA, 22 bp, Homo sapiens
attccttgtttcactgaaaagg

SEQ ID NO: 10043144 - DNA, 22 bp, Homo sapiens
attcctttggactcctccttgc

SEQ ID NO: 10043145 - DNA, 22 bp, Homo sapiens
attcttacaaagcagagtctgt

SEQ ID NO: 10043146 - DNA, 22 bp, Homo sapiens
attaaattagcaaactgtgaaa

SEQ ID NO: 10043147 - DNA, 22 bp, Homo sapiens
attacaaaagaagggagaaggt

SEQ ID NO: 10043148 - DNA, 22 bp, Homo sapiens
gatgatctgcaagaactacatg

SEQ ID NO: 10043149 - DNA, 22 bp, Homo sapiens
gcaagttggagactcatgagaa

SEQ ID NO: 10043150 - DNA, 17 bp, Homo sapiens
gcaagggatgggagatt

SEQ ID NO: 10043151 - DNA, 22 bp, Homo sapiens
gcaaggtgttttataggcagga

SEQ ID NO: 10043152 - DNA, 22 bp, Homo sapiens
gcctgggagatgcgttgtggcc

SEQ ID NO: 10043153 - DNA, 22 bp, Homo sapiens
gcctgggagattaattaggaag

SEQ ID NO: 10043154 - DNA, 18 bp, Homo sapiens
gcctgggaggaggaaatg

SEQ ID NO: 10043155 - DNA, 22 bp, Homo sapiens
gcctgggagcacatcggggtcc

SEQ ID NO: 10043156 - DNA, 22 bp, Homo sapiens
gcctgggagagggatagtgcag

SEQ ID NO: 10043157 - DNA, 22 bp, Homo sapiens
gcctctcctggagaaggcaggg

SEQ ID NO: 10043158 - DNA, 22 bp, Homo sapiens
gcctctccgagccactgcctct

SEQ ID NO: 10043159 - DNA, 22 bp, Homo sapiens
gcctctcctcttaataccatta

SEQ ID NO: 10043160 - DNA, 22 bp, Homo sapiens
gcctctcctcttaataccatta

SEQ ID NO: 10043161 - DNA, 22 bp, Homo sapiens
gcctctccgagccactgcctct

SEQ ID NO: 10043162 - DNA, 21 bp, Homo sapiens
gcctctccaaatcctgccttc

SEQ ID NO: 10043163 - DNA, 21 bp, Homo sapiens
gcctctccaaatcctgccttc

SEQ ID NO: 10043164 - DNA, 23 bp, Homo sapiens
gcctgggagttgcgatctgcccg

SEQ ID NO: 10043165 - DNA, 16 bp, Homo sapiens
gcctgggagggaacag

SEQ ID NO: 10043166 - DNA, 22 bp, Homo sapiens
gcctgggagggcagcagtgtgg

SEQ ID NO: 10043167 - DNA, 22 bp, Homo sapiens
gcctgggagtgcacagtgaggt

SEQ ID NO: 10043168 - DNA, 22 bp, Homo sapiens
caaaacattctctgcagcaggg

SEQ ID NO: 10043169 - DNA, 22 bp, Homo sapiens
caaaaaacacctgtgtgagtat

SEQ ID NO: 10043170 - DNA, 22 bp, Homo sapiens
gcctgtgcctcagcctgcagcc

SEQ ID NO: 10043171 - DNA, 22 bp, Homo sapiens
gcgagggcacgcggttgaaggc

SEQ ID NO: 10043172 - DNA, 22 bp, Homo sapiens
gctcagcttgggagcgcccggt

SEQ ID NO: 10043173 - DNA, 22 bp, Homo sapiens
attgcttgaattaccatgtaat

SEQ ID NO: 10043174 - DNA, 22 bp, Homo sapiens
attgcttgatgattcatagtaa

SEQ ID NO: 10043175 - DNA, 22 bp, Homo sapiens
gccaggagggaaaggacaattt

SEQ ID NO: 10043176 - DNA, 22 bp, Homo sapiens
atttccttgcaagtttctgtaa

SEQ ID NO: 10043177 - DNA, 22 bp, Homo sapiens
atttccttgcaacttaggcatg

SEQ ID NO: 10043178 - DNA, 22 bp, Homo sapiens
atttcctttgcaaagactgtgc

SEQ ID NO: 10043179 - DNA, 16 bp, Homo sapiens
atttccttgtgagttt

SEQ ID NO: 10043180 - DNA, 22 bp, Homo sapiens
atttccttcggacagtttgggt

SEQ ID NO: 10043181 - DNA, 22 bp, Homo sapiens
atttccttcccagatttggttc

SEQ ID NO: 10043182 - DNA, 22 bp, Homo sapiens
atgaagcagcctcttccctctg

SEQ ID NO: 10043183 - DNA, 22 bp, Homo sapiens
atgaagcagcgttgtagagtga

SEQ ID NO: 10043184 - DNA, 22 bp, Homo sapiens
atgaagcagatttattactcac

SEQ ID NO: 10043185 - DNA, 22 bp, Homo sapiens
atgaagcagaatttcccactct

SEQ ID NO: 10043186 - DNA, 22 bp, Homo sapiens
atgaagcagactcaggtggtgc

SEQ ID NO: 10043187 - DNA, 22 bp, Homo sapiens
atgaagcaacagccctcctatt

SEQ ID NO: 10043188 - DNA, 22 bp, Homo sapiens
atgagttgaagctacaagaggc

SEQ ID NO: 10043189 - DNA, 22 bp, Homo sapiens
atgataagaacacagtatgggg

SEQ ID NO: 10043190 - DNA, 22 bp, Homo sapiens
atgataagccatgtcgtggtca

SEQ ID NO: 10043191 - DNA, 22 bp, Homo sapiens
atgcagaagcagaacttacaca

SEQ ID NO: 10043192 - DNA, 22 bp, Homo sapiens
atgcagaagcagaacttacaca

SEQ ID NO: 10043193 - DNA, 22 bp, Homo sapiens
atgcagaagactgaaaagctga

SEQ ID NO: 10043194 - DNA, 22 bp, Homo sapiens
atgcaaaagtagttgcagtttt

SEQ ID NO: 10043195 - DNA, 22 bp, Homo sapiens
cttgctaatcactcggtgtcat

SEQ ID NO: 10043196 - DNA, 22 bp, Homo sapiens
atctatgtgcctttgtatagaa

SEQ ID NO: 10043197 - DNA, 22 bp, Homo sapiens
atcttgaaatactttctagaat

SEQ ID NO: 10043198 - DNA, 22 bp, Homo sapiens
cttggcccggagccccatgaag

SEQ ID NO: 10043199 - DNA, 22 bp, Homo sapiens
cttggcccagttgccaaggaaa

SEQ ID NO: 10043200 - DNA, 22 bp, Homo sapiens
cttggcccagttgccaaggaaa

SEQ ID NO: 10043201 - DNA, 22 bp, Homo sapiens
atctttgggatcctgatttact

SEQ ID NO: 10043202 - DNA, 22 bp, Homo sapiens
atgaaaagttcgatctagaagg

SEQ ID NO: 10043203 - DNA, 22 bp, Homo sapiens
gaggggagaggcttatggatca

SEQ ID NO: 10043204 - DNA, 22 bp, Homo sapiens
atgtacattcttctcaccgaag

SEQ ID NO: 10043205 - DNA, 22 bp, Homo sapiens
atggtaacagttgagtagaaac

SEQ ID NO: 10043206 - DNA, 22 bp, Homo sapiens
atggcagcggagctggaaatga

SEQ ID NO: 10043207 - DNA, 22 bp, Homo sapiens
atggcagagggattgaacagct

SEQ ID NO: 10043208 - DNA, 22 bp, Homo sapiens
atggccagtcaagcctctggct

SEQ ID NO: 10043209 - DNA, 22 bp, Homo sapiens
atggcccactctggtcccggca

SEQ ID NO: 10043210 - DNA, 22 bp, Homo sapiens
atggcccagaagtttggaaagg

SEQ ID NO: 10043211 - DNA, 22 bp, Homo sapiens
atggcccagactcagactggtg

SEQ ID NO: 10043212 - DNA, 22 bp, Homo sapiens
atggcccaggccaggatccagc

SEQ ID NO: 10043213 - DNA, 22 bp, Homo sapiens
atggcccaggcctcctgtggct

SEQ ID NO: 10043214 - DNA, 22 bp, Homo sapiens
atggcccaggcaggctggtact

SEQ ID NO: 10043215 - DNA, 22 bp, Homo sapiens
atggcccaagtgccctgacctg

SEQ ID NO: 10043216 - DNA, 22 bp, Homo sapiens
atggcccaaactgcaattactt

SEQ ID NO: 10043217 - DNA, 22 bp, Homo sapiens
atggcccaaaacctcctccctc

SEQ ID NO: 10043218 - DNA, 19 bp, Homo sapiens
atggccagtttagaggttt

SEQ ID NO: 10043219 - DNA, 22 bp, Homo sapiens
atggccagtgtttccctcagtt

SEQ ID NO: 10043220 - DNA, 22 bp, Homo sapiens
atggaaaaggctgatttcatta

SEQ ID NO: 10043221 - DNA, 22 bp, Homo sapiens
atggaactgatcaggagtgcca

SEQ ID NO: 10043222 - DNA, 22 bp, Homo sapiens
agaatgcaagataaactttatt

SEQ ID NO: 10043223 - DNA, 22 bp, Homo sapiens
agaatgcagtttgaaataaggt

SEQ ID NO: 10043224 - DNA, 22 bp, Homo sapiens
atctttggtgcttggtgctccc

SEQ ID NO: 10043225 - DNA, 22 bp, Homo sapiens
atctttggtcttgagtgcatct

SEQ ID NO: 10043226 - DNA, 22 bp, Homo sapiens
atctttggtgcatgatactttg

SEQ ID NO: 10043227 - DNA, 22 bp, Homo sapiens
atctttggtactattcttatca

SEQ ID NO: 10043228 - DNA, 19 bp, Homo sapiens
atctttgggtcctgaaggg

SEQ ID NO: 10043229 - DNA, 22 bp, Homo sapiens
atctttggggcatccaggaaaa

SEQ ID NO: 10043230 - DNA, 22 bp, Homo sapiens
atctttgggcaatgatgaggga

SEQ ID NO: 10043231 - DNA, 22 bp, Homo sapiens
atctttgggtacaaacttgcct

SEQ ID NO: 10043232 - DNA, 22 bp, Homo sapiens
agaatacagttcagtaatggat

SEQ ID NO: 10043233 - DNA, 22 bp, Homo sapiens
agaatataaagataattctgtt

SEQ ID NO: 10043234 - DNA, 22 bp, Homo sapiens
agaagtttggtccttttcaagg

SEQ ID NO: 10043235 - DNA, 22 bp, Homo sapiens
agaagtttgttatgtaaacaaa

SEQ ID NO: 10043236 - DNA, 22 bp, Homo sapiens
atggcagccagtgttggaggaa

SEQ ID NO: 10043237 - DNA, 22 bp, Homo sapiens
atggcagcagctttagctgtgg

SEQ ID NO: 10043238 - DNA, 22 bp, Homo sapiens
atggcagcatgggattggtaga

SEQ ID NO: 10043239 - DNA, 22 bp, Homo sapiens
atggataagtcaaagagtatcc

SEQ ID NO: 10043240 - DNA, 22 bp, Homo sapiens
atggcagatggctggagcaggt

SEQ ID NO: 10043241 - DNA, 22 bp, Homo sapiens
atggcagcaaatgtctggctgg

SEQ ID NO: 10043242 - DNA, 22 bp, Homo sapiens
atggagtgctgttgatcaaggt

SEQ ID NO: 10043243 - DNA, 19 bp, Homo sapiens
atggaaaattgtactcaat

SEQ ID NO: 10043244 - DNA, 22 bp, Homo sapiens
atggaaaagggtctttcatttc

SEQ ID NO: 10043245 - DNA, 19 bp, Homo sapiens
atggaaaatgccagactga

SEQ ID NO: 10043246 - DNA, 22 bp, Homo sapiens
atgcttgctaatagtgggaacc

SEQ ID NO: 10043247 - DNA, 22 bp, Homo sapiens
atgtttgaggactcagaagacg

SEQ ID NO: 10043248 - DNA, 22 bp, Homo sapiens
agagggagtgaaatggaataga

SEQ ID NO: 10043249 - DNA, 22 bp, Homo sapiens
agagggagctttatttttctgt

SEQ ID NO: 10043250 - DNA, 22 bp, Homo sapiens
agagggagcccagtcatagctg

SEQ ID NO: 10043251 - DNA, 21 bp, Homo sapiens
agagggagagtggcccttcca

SEQ ID NO: 10043252 - DNA, 23 bp, Homo sapiens
agagggagatgtttttctcaaga

SEQ ID NO: 10043253 - DNA, 17 bp, Homo sapiens
agcaaaagtatcaaagc

SEQ ID NO: 10043254 - DNA, 22 bp, Homo sapiens
agcagcagaaagttgatggcag

SEQ ID NO: 10043255 - DNA, 22 bp, Homo sapiens
agcagcagaagggagacccagg

SEQ ID NO: 10043256 - DNA, 22 bp, Homo sapiens
agcagacaccaggagtaaagaa

SEQ ID NO: 10043257 - DNA, 22 bp, Homo sapiens
agcagaagtgccttagcaatca

SEQ ID NO: 10043258 - DNA, 22 bp, Homo sapiens
caatgaaattgagatccagaga

SEQ ID NO: 10043259 - DNA, 22 bp, Homo sapiens
caatcttagtggcttacaaaga

SEQ ID NO: 10043260 - DNA, 22 bp, Homo sapiens
caaggcagttccccagagggct

SEQ ID NO: 10043261 - DNA, 22 bp, Homo sapiens
caaatgatccttgcaagctgtg

SEQ ID NO: 10043262 - DNA, 22 bp, Homo sapiens
agcagaagaggtcttgttgctg

SEQ ID NO: 10043263 - DNA, 22 bp, Homo sapiens
agcacaaaaacattcccagagt

SEQ ID NO: 10043264 - DNA, 22 bp, Homo sapiens
cactctggttctgaacaggatc

SEQ ID NO: 10043265 - DNA, 22 bp, Homo sapiens
agcagtggctgaagatgttcct

SEQ ID NO: 10043266 - DNA, 22 bp, Homo sapiens
cacatcaagcatccatgagttt

SEQ ID NO: 10043267 - DNA, 22 bp, Homo sapiens
cacatctgctctgggcagcact

SEQ ID NO: 10043268 - DNA, 22 bp, Homo sapiens
agcagctgttagaaacaggaag

SEQ ID NO: 10043269 - DNA, 22 bp, Homo sapiens
agcaggagagcagtgcgtggtc

SEQ ID NO: 10043270 - DNA, 22 bp, Homo sapiens
agcaggagatggggcgtgatgt

SEQ ID NO: 10043271 - DNA, 22 bp, Homo sapiens
cagcagcagtgttctagaatct

SEQ ID NO: 10043272 - DNA, 22 bp, Homo sapiens
cagcagcagccccaggaaggtt

SEQ ID NO: 10043273 - DNA, 22 bp, Homo sapiens
cagcagagcttatgttgggtca

SEQ ID NO: 10043274 - DNA, 22 bp, Homo sapiens
cagcagaggcacgtctgtgaat

SEQ ID NO: 10043275 - DNA, 22 bp, Homo sapiens
cagcagagggagccattgaaat

SEQ ID NO: 10043276 - DNA, 22 bp, Homo sapiens
cagcagaggttggaacagttct

SEQ ID NO: 10043277 - DNA, 22 bp, Homo sapiens
cagcagaggtggttcacattgt

SEQ ID NO: 10043278 - DNA, 22 bp, Homo sapiens
cagcacaggcccctctctccca

SEQ ID NO: 10043279 - DNA, 22 bp, Homo sapiens
cagcacagggcttgagaggtgt

SEQ ID NO: 10043280 - DNA, 22 bp, Homo sapiens
agcctattccaggatgagctca

SEQ ID NO: 10043281 - DNA, 22 bp, Homo sapiens
cagaggcctttctacagtgata

SEQ ID NO: 10043282 - DNA, 23 bp, Homo sapiens
cagcaggagggtgcctgggctgc

SEQ ID NO: 10043283 - DNA, 22 bp, Homo sapiens
agcctttatactgtgtaaggca

SEQ ID NO: 10043284 - DNA, 22 bp, Homo sapiens
agcctttacaagcattagctca

SEQ ID NO: 10043285 - DNA, 22 bp, Homo sapiens
agcctttaagctgccacagctg

SEQ ID NO: 10043286 - DNA, 22 bp, Homo sapiens
agcctttaaggaaaatgaataa

SEQ ID NO: 10043287 - DNA, 22 bp, Homo sapiens
cagcaggaggcatggcttccct

SEQ ID NO: 10043288 - DNA, 22 bp, Homo sapiens
agcctttaacacttcacattga

SEQ ID NO: 10043289 - DNA, 22 bp, Homo sapiens
agcctttaagcagcgcagcatt

SEQ ID NO: 10043290 - DNA, 22 bp, Homo sapiens
agcctttaactggataaagtgt

SEQ ID NO: 10043291 - DNA, 23 bp, Homo sapiens
agccttggaggttgaggctgcag

SEQ ID NO: 10043292 - DNA, 22 bp, Homo sapiens
cagacagacctgcaagggcaca

SEQ ID NO: 10043293 - DNA, 22 bp, Homo sapiens
agcccagctttgaaccatatca

SEQ ID NO: 10043294 - DNA, 22 bp, Homo sapiens
cagacagaaggctccttgaggt

SEQ ID NO: 10043295 - DNA, 22 bp, Homo sapiens
acatgagaggctgtggagtaca

SEQ ID NO: 10043296 - DNA, 22 bp, Homo sapiens
aggcaggggagctggaagggta

SEQ ID NO: 10043297 - DNA, 22 bp, Homo sapiens
aggccctggtcaggtctggctg

SEQ ID NO: 10043298 - DNA, 22 bp, Homo sapiens
aggccctgtccatggtgctgaa

SEQ ID NO: 10043299 - DNA, 22 bp, Homo sapiens
acatggagctcaaacatgagtg

SEQ ID NO: 10043300 - DNA, 22 bp, Homo sapiens
aggccttcctcggagacaggga

SEQ ID NO: 10043301 - DNA, 22 bp, Homo sapiens
aggctaggcatgtgctaccaca

SEQ ID NO: 10043302 - DNA, 22 bp, Homo sapiens
agggagctcagttggaagcggt

SEQ ID NO: 10043303 - DNA, 22 bp, Homo sapiens
accatcagtactggatgctgac

SEQ ID NO: 10043304 - DNA, 22 bp, Homo sapiens
accatgttggccaagctggtct

SEQ ID NO: 10043305 - DNA, 22 bp, Homo sapiens
accattctggtccatactgttc

SEQ ID NO: 10043306 - DNA, 20 bp, Homo sapiens
agggcagcttgaggagccgg

SEQ ID NO: 10043307 - DNA, 22 bp, Homo sapiens
acagtttggttgctacagtaaa

SEQ ID NO: 10043308 - DNA, 22 bp, Homo sapiens
aggcagcatgggcccagagtcc

SEQ ID NO: 10043309 - DNA, 22 bp, Homo sapiens
aggcagcatgggccccagctcc

SEQ ID NO: 10043310 - DNA, 22 bp, Homo sapiens
acagggtggggatggtgagctt

SEQ ID NO: 10043311 - DNA, 22 bp, Homo sapiens
aggagtcagatatgggaaagtt

SEQ ID NO: 10043312 - DNA, 22 bp, Homo sapiens
aggagtcactcagggcttcatc

SEQ ID NO: 10043313 - DNA, 22 bp, Homo sapiens
aggagtggaattactgggttct

SEQ ID NO: 10043314 - DNA, 22 bp, Homo sapiens
aggagtctgttgaaatgtctat

SEQ ID NO: 10043315 - DNA, 22 bp, Homo sapiens
acagctgtgaagcaagcactct

SEQ ID NO: 10043316 - DNA, 22 bp, Homo sapiens
acagcagacattgggtgattga

SEQ ID NO: 10043317 - DNA, 22 bp, Homo sapiens
acagcagacagtcggcttcctg

SEQ ID NO: 10043318 - DNA, 21 bp, Homo sapiens
acagcagacaggcttaggacc

SEQ ID NO: 10043319 - DNA, 23 bp, Homo sapiens
acagcacccatgtcatctggctc

SEQ ID NO: 10043320 - DNA, 22 bp, Homo sapiens
acagcacttattcagcacagtg

SEQ ID NO: 10043321 - DNA, 22 bp, Homo sapiens
acagcagacacaggcacgctgt

SEQ ID NO: 10043322 - DNA, 22 bp, Homo sapiens
acagcagaataatgagtaatag

SEQ ID NO: 10043323 - DNA, 22 bp, Homo sapiens
acagctctgcatggcagttatt

SEQ ID NO: 10043324 - DNA, 22 bp, Homo sapiens
acagctgcaaattgttagagga

SEQ ID NO: 10043325 - DNA, 22 bp, Homo sapiens
atatgaaaatgttttagctgta

SEQ ID NO: 10043326 - DNA, 22 bp, Homo sapiens
atatcttttagagcaagcttgt

SEQ ID NO: 10043327 - DNA, 22 bp, Homo sapiens
atatctttgtatggttcagcag

SEQ ID NO: 10043328 - DNA, 22 bp, Homo sapiens
atatctttcaaagccaaaagta

SEQ ID NO: 10043329 - DNA, 22 bp, Homo sapiens
atatctttgtttttgccaagat

SEQ ID NO: 10043330 - DNA, 22 bp, Homo sapiens
actgtgtgctggacatgatgtt

SEQ ID NO: 10043331 - DNA, 22 bp, Homo sapiens
acttcagtgtggtataaaacgt

SEQ ID NO: 10043332 - DNA, 21 bp, Homo sapiens
acttggccaggcccccacctg

SEQ ID NO: 10043333 - DNA, 22 bp, Homo sapiens
acttggccttatttccacagaa

SEQ ID NO: 10043334 - DNA, 20 bp, Homo sapiens
acttgcttttgtcaggaaaa

SEQ ID NO: 10043335 - DNA, 19 bp, Homo sapiens
actcaggcttcctctgagg

SEQ ID NO: 10043336 - DNA, 22 bp, Homo sapiens
aggtacagtagacagacagtta

SEQ ID NO: 10043337 - DNA, 22 bp, Homo sapiens
aggtagcgcaatttcctgggac

SEQ ID NO: 10043338 - DNA, 22 bp, Homo sapiens
agggtggggtgctacatcttta

SEQ ID NO: 10043339 - DNA, 20 bp, Homo sapiens
agggtggggacgttctgact

SEQ ID NO: 10043340 - DNA, 22 bp, Homo sapiens
agggtgggctagactcttcccc

SEQ ID NO: 10043341 - DNA, 22 bp, Homo sapiens
actgcacacctccagggcacta

SEQ ID NO: 10043342 - DNA, 22 bp, Homo sapiens
aagatattttagaacattcact

SEQ ID NO: 10043343 - DNA, 22 bp, Homo sapiens
aagattcccagagaagttccac

SEQ ID NO: 10043344 - DNA, 22 bp, Homo sapiens
aagcagcatatgacagcatcca

SEQ ID NO: 10043345 - DNA, 22 bp, Homo sapiens
aagcaggagatgcaggaatgta

SEQ ID NO: 10043346 - DNA, 22 bp, Homo sapiens
aacataaatttgaagtggcaaa

SEQ ID NO: 10043347 - DNA, 22 bp, Homo sapiens
aacacttatccacatttgaaag

SEQ ID NO: 10043348 - DNA, 22 bp, Homo sapiens
aacacttctcatcactgcaagc

SEQ ID NO: 10043349 - DNA, 22 bp, Homo sapiens
aaagcaagtctctacaaagtac

SEQ ID NO: 10043350 - DNA, 22 bp, Homo sapiens
aaccccgctcaggctgggtgag

SEQ ID NO: 10043351 - DNA, 22 bp, Homo sapiens
aaagaaacctatcagccacatg

SEQ ID NO: 10043352 - DNA, 22 bp, Homo sapiens
aaagagcaccctcaatgtctga

SEQ ID NO: 10043353 - DNA, 22 bp, Homo sapiens
aaagatgttatgaaataactat

SEQ ID NO: 10043354 - DNA, 22 bp, Homo sapiens
aaagatgtgtaagaaataaaca

SEQ ID NO: 10043355 - DNA, 22 bp, Homo sapiens
aaacattagacaccatatgctc

SEQ ID NO: 10043356 - DNA, 22 bp, Homo sapiens
aaacactgtgggacatcttact

SEQ ID NO: 10043357 - DNA, 22 bp, Homo sapiens
aaacactgaaaattttggtcat

SEQ ID NO: 10043358 - DNA, 22 bp, Homo sapiens
aaacactgaagacctatctggt

SEQ ID NO: 10043359 - DNA, 22 bp, Homo sapiens
aaaaagtttcaactgccaactc

SEQ ID NO: 10043360 - DNA, 22 bp, Homo sapiens
aaaattaagtgtctgggaagcc

SEQ ID NO: 10043361 - DNA, 22 bp, Homo sapiens
aaaagggactactctcagctcc

SEQ ID NO: 10043362 - DNA, 22 bp, Homo sapiens
aaaaggtagttgccaaataagg

SEQ ID NO: 10043363 - DNA, 22 bp, Homo sapiens
aaacacatcattcatgtcgtca

SEQ ID NO: 10043364 - DNA, 22 bp, Homo sapiens
aaagagctggcatttatagtct

SEQ ID NO: 10043365 - DNA, 22 bp, Homo sapiens
aaagagctgggacttaaagtgc

SEQ ID NO: 10043366 - DNA, 22 bp, Homo sapiens
aaggcagccctggctcagcctg

SEQ ID NO: 10043367 - DNA, 22 bp, Homo sapiens
aaggcagcaccgcctcctgaaa

SEQ ID NO: 10043368 - DNA, 22 bp, Homo sapiens
aaattcaatgatcactggctca

SEQ ID NO: 10043369 - DNA, 21 bp, Homo sapiens
aaattcacctagtaaaacttc

SEQ ID NO: 10043370 - DNA, 22 bp, Homo sapiens
aatgacagtggcacagtcactt

SEQ ID NO: 10043371 - DNA, 22 bp, Homo sapiens
aacatctagttcctatataata

SEQ ID NO: 10043372 - DNA, 22 bp, Homo sapiens
aagtgcttggattgcaggtatg

SEQ ID NO: 10043373 - DNA, 22 bp, Homo sapiens
aacatcatcatgaacaactaat

SEQ ID NO: 10043374 - DNA, 22 bp, Homo sapiens
aacatcagaatatccatgttgg

SEQ ID NO: 10043375 - DNA, 22 bp, Homo sapiens
aacagcttcatcacatggcata

SEQ ID NO: 10043376 - DNA, 22 bp, Homo sapiens
aattctctccagggtaacatca

SEQ ID NO: 10043377 - DNA, 21 bp, Homo sapiens
acacaaacctcctcagcctgg

SEQ ID NO: 10043378 - DNA, 22 bp, Homo sapiens
aagagaatgacaaggagaacct

SEQ ID NO: 10043379 - DNA, 22 bp, Homo sapiens
aagcagagaatctgggagcgag

SEQ ID NO: 10043380 - DNA, 22 bp, Homo sapiens
aagcagagccaccagctttgga

SEQ ID NO: 10043381 - DNA, 22 bp, Homo sapiens
aagcagagcctgagacagggat

SEQ ID NO: 10043382 - DNA, 22 bp, Homo sapiens
aagcagaatttcccactagttg

SEQ ID NO: 10043383 - DNA, 22 bp, Homo sapiens
aagcagaatttaatagaaaggt

SEQ ID NO: 10043384 - DNA, 22 bp, Homo sapiens
aagcagaatagaggcccttccc

SEQ ID NO: 10043385 - DNA, 20 bp, Homo sapiens
aagcagaagctgctctcagc

SEQ ID NO: 10043386 - DNA, 22 bp, Homo sapiens
aagcagaactgggaagtagtgg

SEQ ID NO: 10043387 - DNA, 22 bp, Homo sapiens
acagcagagtagttttccaact

SEQ ID NO: 10043388 - DNA, 22 bp, Homo sapiens
acagcagaggaaaagtctgata

SEQ ID NO: 10043389 - DNA, 22 bp, Homo sapiens
acagcagagcctagcttaatct

SEQ ID NO: 10043390 - DNA, 22 bp, Homo sapiens
acagcagagcctggtacttact

SEQ ID NO: 10043391 - DNA, 22 bp, Homo sapiens
aagcaggaagctcaggtccttg

SEQ ID NO: 10043392 - DNA, 22 bp, Homo sapiens
aagcagaggccacagagtgggc

SEQ ID NO: 10043393 - DNA, 22 bp, Homo sapiens
aagcagaggaccgacggaggga

SEQ ID NO: 10043394 - DNA, 22 bp, Homo sapiens
aagcagagggtatggccaggtt

SEQ ID NO: 10043395 - DNA, 22 bp, Homo sapiens
aagcagaggtagggtgtgcagt

SEQ ID NO: 10043396 - DNA, 22 bp, Homo sapiens
acagcagaccccagtgccatgg

SEQ ID NO: 10043397 - DNA, 22 bp, Homo sapiens
acagcagagccagtggctctag

SEQ ID NO: 10043398 - DNA, 22 bp, Homo sapiens
acagcagagcaccagggccact

SEQ ID NO: 10043399 - DNA, 21 bp, Homo sapiens
acagcagagatcaagactaag

SEQ ID NO: 10043400 - DNA, 22 bp, Homo sapiens
acagcagagacactcaggaggc

SEQ ID NO: 10043401 - DNA, 22 bp, Homo sapiens
acagcagagaactttagagggt

SEQ ID NO: 10043402 - DNA, 22 bp, Homo sapiens
acagcagactttctacagctca

SEQ ID NO: 10043403 - DNA, 22 bp, Homo sapiens
aagcaaggcaacctatgtccag

SEQ ID NO: 10043404 - DNA, 22 bp, Homo sapiens
aagcaaggccggaaggaaactc

SEQ ID NO: 10043405 - DNA, 22 bp, Homo sapiens
aagcaaggcccagagcatcagc

SEQ ID NO: 10043406 - DNA, 22 bp, Homo sapiens
acagtcttgagcatcagccaga

SEQ ID NO: 10043407 - DNA, 22 bp, Homo sapiens
acatatgtgcttatatccatga

SEQ ID NO: 10043408 - DNA, 22 bp, Homo sapiens
acatatgtgttgtacatgcatg

SEQ ID NO: 10043409 - DNA, 19 bp, Homo sapiens
acagcctgttggtggggct

SEQ ID NO: 10043410 - DNA, 22 bp, Homo sapiens
aaggcctcttctctctggagat

SEQ ID NO: 10043411 - DNA, 22 bp, Homo sapiens
aaggccttgccgaaggatgcca

SEQ ID NO: 10043412 - DNA, 22 bp, Homo sapiens
aaggccttgcctgacagcacca

SEQ ID NO: 10043413 - DNA, 22 bp, Homo sapiens
aaggcctttcttatcagtagat

SEQ ID NO: 10043414 - DNA, 22 bp, Homo sapiens
accctcttgagggaagcacttt

SEQ ID NO: 10043415 - DNA, 22 bp, Homo sapiens
accctgagccgccaggaaggcc

SEQ ID NO: 10043416 - DNA, 22 bp, Homo sapiens
agaagcagaaggaagcagggcc

SEQ ID NO: 10043417 - DNA, 22 bp, Homo sapiens
aatcataattcaaataagctta

SEQ ID NO: 10043418 - DNA, 22 bp, Homo sapiens
aatatagttctagaaatatttt

SEQ ID NO: 10043419 - DNA, 22 bp, Homo sapiens
actgcactccaacctgggtgac

SEQ ID NO: 10043420 - DNA, 22 bp, Homo sapiens
actgcactccagcccgagcaac

SEQ ID NO: 10043421 - DNA, 22 bp, Homo sapiens
actgcactccagcctgggtaac

SEQ ID NO: 10043422 - DNA, 22 bp, Homo sapiens
actgcactccagcctcggggtc

SEQ ID NO: 10043423 - DNA, 19 bp, Homo sapiens
actgcactccagcctgggt

SEQ ID NO: 10043424 - DNA, 22 bp, Homo sapiens
actggacagaggaaatatggag

SEQ ID NO: 10043425 - DNA, 22 bp, Homo sapiens
actggcccgggagcagaggcct

SEQ ID NO: 10043426 - DNA, 22 bp, Homo sapiens
aataccttccaacatcaagaca

SEQ ID NO: 10043427 - DNA, 22 bp, Homo sapiens
actctcccacgttcgactctaa

SEQ ID NO: 10043428 - DNA, 22 bp, Homo sapiens
actctccctgctatccacttcc

SEQ ID NO: 10043429 - DNA, 22 bp, Homo sapiens
acggtgccggtggtgatgagcc

SEQ ID NO: 10043430 - DNA, 22 bp, Homo sapiens
aagtctaaacacatatttaaaa

SEQ ID NO: 10043431 - DNA, 22 bp, Homo sapiens
aattgagtgctagacatcatga

SEQ ID NO: 10043432 - DNA, 21 bp, Homo sapiens
agaggccctcggactgggcgt

SEQ ID NO: 10043433 - DNA, 22 bp, Homo sapiens
agagggggaaaatagaggtgtt

SEQ ID NO: 10043434 - DNA, 22 bp, Homo sapiens
acaagagattatctacagatga

SEQ ID NO: 10043435 - DNA, 22 bp, Homo sapiens
agataagctgtttttcaagaat

SEQ ID NO: 10043436 - DNA, 22 bp, Homo sapiens
acaacagagctggactgagagg

SEQ ID NO: 10043437 - DNA, 22 bp, Homo sapiens
acaacacagcaaaaccccatct

SEQ ID NO: 10043438 - DNA, 22 bp, Homo sapiens
acaagcagaaggtggggtctta

SEQ ID NO: 10043439 - DNA, 22 bp, Homo sapiens
aattaaaaaaggagagcttgct

SEQ ID NO: 10043440 - DNA, 18 bp, Homo sapiens
agaccctctaagggcagt

SEQ ID NO: 10043441 - DNA, 22 bp, Homo sapiens
agagacaggagttctgtttcca

SEQ ID NO: 10043442 - DNA, 22 bp, Homo sapiens
agcagcaaagaataggccctct

SEQ ID NO: 10043443 - DNA, 22 bp, Homo sapiens
agcagctgagccccagctgtga

SEQ ID NO: 10043444 - DNA, 22 bp, Homo sapiens
acacccaggaataaggactggg

SEQ ID NO: 10043445 - DNA, 22 bp, Homo sapiens
acactctgtgaggcatgtaatg

SEQ ID NO: 10043446 - DNA, 22 bp, Homo sapiens
acactgagtattgagtagggta

SEQ ID NO: 10043447 - DNA, 22 bp, Homo sapiens
acactgagtgagaaaaggaaat

SEQ ID NO: 10043448 - DNA, 22 bp, Homo sapiens
acactgagcttccaagatgggg

SEQ ID NO: 10043449 - DNA, 22 bp, Homo sapiens
acactgactgggacagaagacc

SEQ ID NO: 10043450 - DNA, 22 bp, Homo sapiens
acactgacgcttgacagtcacc

SEQ ID NO: 10043451 - DNA, 22 bp, Homo sapiens
agcagctggttcccgagggcgt

SEQ ID NO: 10043452 - DNA, 22 bp, Homo sapiens
acagagaaagttcctctcaggc

SEQ ID NO: 10043453 - DNA, 23 bp, Homo sapiens
acagacattccataatgtacacc

SEQ ID NO: 10043454 - DNA, 22 bp, Homo sapiens
acagacagacagattgcatatg

SEQ ID NO: 10043455 - DNA, 22 bp, Homo sapiens
acagacagacagattgcatatg

SEQ ID NO: 10043456 - DNA, 22 bp, Homo sapiens
acagacaagtagttcagacaag

SEQ ID NO: 10043457 - DNA, 22 bp, Homo sapiens
agcctctgatgatcacaggggg

SEQ ID NO: 10043458 - DNA, 22 bp, Homo sapiens
agcctctgatggctcccaagga

SEQ ID NO: 10043459 - DNA, 22 bp, Homo sapiens
ggagaagcaggtgctttgggtc

SEQ ID NO: 10043460 - DNA, 22 bp, Homo sapiens
ggagaagccaggtgataagcaa

SEQ ID NO: 10043461 - DNA, 22 bp, Homo sapiens
ggaataaaaattgtttactgta

SEQ ID NO: 10043462 - DNA, 22 bp, Homo sapiens
ggaagtttgtatactggcctct

SEQ ID NO: 10043463 - DNA, 22 bp, Homo sapiens
ggaagtttgtagatgtttctta

SEQ ID NO: 10043464 - DNA, 18 bp, Homo sapiens
ggaagtttgggtcccctg

SEQ ID NO: 10043465 - DNA, 22 bp, Homo sapiens
ggaagtttgagcatctgtttcc

SEQ ID NO: 10043466 - DNA, 22 bp, Homo sapiens
ggaagtttgggagctggtaatc

SEQ ID NO: 10043467 - DNA, 22 bp, Homo sapiens
ggaagtttctggtgaggacgag

SEQ ID NO: 10043468 - DNA, 22 bp, Homo sapiens
ggaaggtttttctcctggtggg

SEQ ID NO: 10043469 - DNA, 22 bp, Homo sapiens
ggaagtttattgagttcaagta

SEQ ID NO: 10043470 - DNA, 22 bp, Homo sapiens
ggaagtttcaggaatctgcatt

SEQ ID NO: 10043471 - DNA, 23 bp, Homo sapiens
ggagaggggtgtgggcatcttta

SEQ ID NO: 10043472 - DNA, 22 bp, Homo sapiens
ggagagggtaggggtcctgccc

SEQ ID NO: 10043473 - DNA, 22 bp, Homo sapiens
ggagaggggcaagtttatctag

SEQ ID NO: 10043474 - DNA, 22 bp, Homo sapiens
ggagagggggctccctgcttgg

SEQ ID NO: 10043475 - DNA, 22 bp, Homo sapiens
ggagaggggaacttgttgcttg

SEQ ID NO: 10043476 - DNA, 22 bp, Homo sapiens
ggagagggtgtggaaagttatc

SEQ ID NO: 10043477 - DNA, 22 bp, Homo sapiens
ggaggagcatgagagggtagtg

SEQ ID NO: 10043478 - DNA, 22 bp, Homo sapiens
ggaggagcccactcaaagggga

SEQ ID NO: 10043479 - DNA, 22 bp, Homo sapiens
ggaggagctgctgtgggggccc

SEQ ID NO: 10043480 - DNA, 22 bp, Homo sapiens
ggaggaggcggcagaagttcct

SEQ ID NO: 10043481 - DNA, 22 bp, Homo sapiens
ggaggcagaatagagtgtgggt

SEQ ID NO: 10043482 - DNA, 20 bp, Homo sapiens
ggaaaaatgcatgctcaaga

SEQ ID NO: 10043483 - DNA, 22 bp, Homo sapiens
gcttcagtttaggggttaattg

SEQ ID NO: 10043484 - DNA, 22 bp, Homo sapiens
ggcaggctcagcagccaaggag

SEQ ID NO: 10043485 - DNA, 22 bp, Homo sapiens
ggcaggctgcttgggtcatgtc

SEQ ID NO: 10043486 - DNA, 22 bp, Homo sapiens
ggcaggctggctttgttccagg

SEQ ID NO: 10043487 - DNA, 22 bp, Homo sapiens
ggcagctctgctccttggctcc

SEQ ID NO: 10043488 - DNA, 22 bp, Homo sapiens
ggcacagcacagtggacccagg

SEQ ID NO: 10043489 - DNA, 22 bp, Homo sapiens
ggcagagaatctggctgtttac

SEQ ID NO: 10043490 - DNA, 22 bp, Homo sapiens
ggcagacctctccagccccaca

SEQ ID NO: 10043491 - DNA, 19 bp, Homo sapiens
ggagtgggtagttagtggt

SEQ ID NO: 10043492 - DNA, 22 bp, Homo sapiens
ggagtggcactctgaggcgggg

SEQ ID NO: 10043493 - DNA, 22 bp, Homo sapiens
ggagtggtgtcactgagaggaa

SEQ ID NO: 10043494 - DNA, 21 bp, Homo sapiens
ggagggcagcccagactggct

SEQ ID NO: 10043495 - DNA, 20 bp, Homo sapiens
ggagggcagctgagagttgg

SEQ ID NO: 10043496 - DNA, 22 bp, Homo sapiens
ggagggcatcaatcaggcctgg

SEQ ID NO: 10043497 - DNA, 22 bp, Homo sapiens
ggagggagagtgaccctaccaa

SEQ ID NO: 10043498 - DNA, 22 bp, Homo sapiens
ggagtaggccccgggagagagt

SEQ ID NO: 10043499 - DNA, 22 bp, Homo sapiens
ggcttccccacaaagcacacaa

SEQ ID NO: 10043500 - DNA, 22 bp, Homo sapiens
ggctgccttccctgagccccgg

SEQ ID NO: 10043501 - DNA, 19 bp, Homo sapiens
ggctgccttctgctcatct

SEQ ID NO: 10043502 - DNA, 22 bp, Homo sapiens
ggctgcctgtgcccaggcacac

SEQ ID NO: 10043503 - DNA, 22 bp, Homo sapiens
ggctgccttcatagaccatggg

SEQ ID NO: 10043504 - DNA, 22 bp, Homo sapiens
ggctcctgggcagctgctccct

SEQ ID NO: 10043505 - DNA, 22 bp, Homo sapiens
ggctcctggaaagccctcgctc

SEQ ID NO: 10043506 - DNA, 22 bp, Homo sapiens
ggctcagcttggtgcgcagaaa

SEQ ID NO: 10043507 - DNA, 22 bp, Homo sapiens
ggctcagcttatctgggcaggc

SEQ ID NO: 10043508 - DNA, 22 bp, Homo sapiens
ggccctgcaaggtacccaggcc

SEQ ID NO: 10043509 - DNA, 22 bp, Homo sapiens
ggccctctggcttccgcatggg

SEQ ID NO: 10043510 - DNA, 22 bp, Homo sapiens
ggccctctgtggctgccatgga

SEQ ID NO: 10043511 - DNA, 22 bp, Homo sapiens
ggccctctgagtagctgcaaac

SEQ ID NO: 10043512 - DNA, 22 bp, Homo sapiens
ggccctctgcctgtgctggcga

SEQ ID NO: 10043513 - DNA, 21 bp, Homo sapiens
ggccttcccctgcagtctccg

SEQ ID NO: 10043514 - DNA, 22 bp, Homo sapiens
ggccttcctgttgtgtccaccg

SEQ ID NO: 10043515 - DNA, 22 bp, Homo sapiens
ggccttccttcccagcctactg

SEQ ID NO: 10043516 - DNA, 22 bp, Homo sapiens
ggccttccatctgcctctgttt

SEQ ID NO: 10043517 - DNA, 22 bp, Homo sapiens
ggccccagttcactcctggccg

SEQ ID NO: 10043518 - DNA, 21 bp, Homo sapiens
ggccccgcagacccagcacgt

SEQ ID NO: 10043519 - DNA, 22 bp, Homo sapiens
ggcccagcctcagacatgccct

SEQ ID NO: 10043520 - DNA, 22 bp, Homo sapiens
ggcccagccttggggtttcttt

SEQ ID NO: 10043521 - DNA, 22 bp, Homo sapiens
ggcccagcctggcaacaatgac

SEQ ID NO: 10043522 - DNA, 22 bp, Homo sapiens
ggcccatgcatcctgtgcagcc

SEQ ID NO: 10043523 - DNA, 22 bp, Homo sapiens
ggcccagccggcgagtctcgcg

SEQ ID NO: 10043524 - DNA, 22 bp, Homo sapiens
ggcccacttgaaatggagctca

SEQ ID NO: 10043525 - DNA, 20 bp, Homo sapiens
ggccatgggttgcctgaggt

SEQ ID NO: 10043526 - DNA, 22 bp, Homo sapiens
ggccatgtttggcagaaggatt

SEQ ID NO: 10043527 - DNA, 17 bp, Homo sapiens
ggccatggtgcaaggtt

SEQ ID NO: 10043528 - DNA, 23 bp, Homo sapiens
gggcccagcacaggacctggcag

SEQ ID NO: 10043529 - DNA, 22 bp, Homo sapiens
gggcccagcactggctgggatc

SEQ ID NO: 10043530 - DNA, 22 bp, Homo sapiens
gggcccagcgtggttccatctg

SEQ ID NO: 10043531 - DNA, 22 bp, Homo sapiens
gggcccagccctctgctcactg

SEQ ID NO: 10043532 - DNA, 19 bp, Homo sapiens
gggcccagcatggagggtt

SEQ ID NO: 10043533 - DNA, 22 bp, Homo sapiens
gggcagctcagccaccatgcag

SEQ ID NO: 10043534 - DNA, 22 bp, Homo sapiens
gggcagcacgtttcaggaggat

SEQ ID NO: 10043535 - DNA, 22 bp, Homo sapiens
gggagggaaagcttgatctgtc

SEQ ID NO: 10043536 - DNA, 22 bp, Homo sapiens
gggagggaaggtacctgtgtga

SEQ ID NO: 10043537 - DNA, 22 bp, Homo sapiens
gggagggaaggaccttatgaat

SEQ ID NO: 10043538 - DNA, 22 bp, Homo sapiens
gggagggaaggaggcgccgtgt

SEQ ID NO: 10043539 - DNA, 22 bp, Homo sapiens
gggatggactgacggtagcgcg

SEQ ID NO: 10043540 - DNA, 22 bp, Homo sapiens
gggaccctcaacatctgcttct

SEQ ID NO: 10043541 - DNA, 20 bp, Homo sapiens
gggtgagatgtaggagaggg

SEQ ID NO: 10043542 - DNA, 22 bp, Homo sapiens
gggtgagagtcaggcagagatt

SEQ ID NO: 10043543 - DNA, 22 bp, Homo sapiens
gggtgagacagaaagagcaaaa

SEQ ID NO: 10043544 - DNA, 23 bp, Homo sapiens
gggtgggccaaattaggtagcct

SEQ ID NO: 10043545 - DNA, 17 bp, Homo sapiens
gggtgggcactgctggc

SEQ ID NO: 10043546 - DNA, 22 bp, Homo sapiens
gggtgggccactgagcagcgtg

SEQ ID NO: 10043547 - DNA, 22 bp, Homo sapiens
gggtgggccccaggtatctgta

SEQ ID NO: 10043548 - DNA, 22 bp, Homo sapiens
gggtgggcccagcccagagaag

SEQ ID NO: 10043549 - DNA, 22 bp, Homo sapiens
gggctggagacaagtgagccgc

SEQ ID NO: 10043550 - DNA, 22 bp, Homo sapiens
gttctccttgtggctgcagcag

SEQ ID NO: 10043551 - DNA, 22 bp, Homo sapiens
gtgtgcaagggcatgtacattg

SEQ ID NO: 10043552 - DNA, 22 bp, Homo sapiens
gtgggcagttggtgattctcgt

SEQ ID NO: 10043553 - DNA, 22 bp, Homo sapiens
gtgggcagcctgtccggagacc

SEQ ID NO: 10043554 - DNA, 22 bp, Homo sapiens
gtgggcagcaccagggaagtgt

SEQ ID NO: 10043555 - DNA, 17 bp, Homo sapiens
gtgtacaagcagaaggc

SEQ ID NO: 10043556 - DNA, 22 bp, Homo sapiens
gtggttttgccattacaagtaa

SEQ ID NO: 10043557 - DNA, 22 bp, Homo sapiens
taaaggcctagtaagttgagac

SEQ ID NO: 10043558 - DNA, 22 bp, Homo sapiens
taaaggccatgatggaggatca

SEQ ID NO: 10043559 - DNA, 22 bp, Homo sapiens
taaaggccagggcctgagtgct

SEQ ID NO: 10043560 - DNA, 22 bp, Homo sapiens
taacactgtggtgttctttgtc

SEQ ID NO: 10043561 - DNA, 22 bp, Homo sapiens
taacactgtgtctgccatatcc

SEQ ID NO: 10043562 - DNA, 22 bp, Homo sapiens
taacactgtccaaagaattcca

SEQ ID NO: 10043563 - DNA, 22 bp, Homo sapiens
taacactgtaaacctagatgtt

SEQ ID NO: 10043564 - DNA, 22 bp, Homo sapiens
taacactgtggtgttctttgtc

SEQ ID NO: 10043565 - DNA, 22 bp, Homo sapiens
taacactgtgcccagagtccca

SEQ ID NO: 10043566 - DNA, 22 bp, Homo sapiens
taaatcactcctaataatcagt

SEQ ID NO: 10043567 - DNA, 22 bp, Homo sapiens
taacactgaaaatgatgcatgt

SEQ ID NO: 10043568 - DNA, 22 bp, Homo sapiens
taacactggtatttcatttagt

SEQ ID NO: 10043569 - DNA, 22 bp, Homo sapiens
taacactggtatttcatttagt

SEQ ID NO: 10043570 - DNA, 22 bp, Homo sapiens
taacactggttatccctgtgca

SEQ ID NO: 10043571 - DNA, 22 bp, Homo sapiens
taacactggcttttgctgaggc

SEQ ID NO: 10043572 - DNA, 22 bp, Homo sapiens
taacactgccatgctggagtca

SEQ ID NO: 10043573 - DNA, 22 bp, Homo sapiens
taacactgcttcattttggaga

SEQ ID NO: 10043574 - DNA, 22 bp, Homo sapiens
taacactggagagttggttgtg

SEQ ID NO: 10043575 - DNA, 22 bp, Homo sapiens
taacactgaaaatgatgcatgt

SEQ ID NO: 10043576 - DNA, 22 bp, Homo sapiens
taacactgatttgttctcaggg

SEQ ID NO: 10043577 - DNA, 22 bp, Homo sapiens
gtgggagaaattagctctagtt

SEQ ID NO: 10043578 - DNA, 22 bp, Homo sapiens
gtggcccaggctggagtgcagt

SEQ ID NO: 10043579 - DNA, 22 bp, Homo sapiens
gtggcccaggcttggcgctggc

SEQ ID NO: 10043580 - DNA, 22 bp, Homo sapiens
gtggcccaggcaccctgatgac

SEQ ID NO: 10043581 - DNA, 22 bp, Homo sapiens
gtggcccatcacgtttcgcctt

SEQ ID NO: 10043582 - DNA, 22 bp, Homo sapiens
gtggcccaggttggagtgcagt

SEQ ID NO: 10043583 - DNA, 22 bp, Homo sapiens
gtggcccagccctacagaggac

SEQ ID NO: 10043584 - DNA, 22 bp, Homo sapiens
gtggcccacttacgtcatgtgt

SEQ ID NO: 10043585 - DNA, 22 bp, Homo sapiens
gtggcccacacagacagcatct

SEQ ID NO: 10043586 - DNA, 22 bp, Homo sapiens
gtggaaaagaaagtcttccttg

SEQ ID NO: 10043587 - DNA, 22 bp, Homo sapiens
gtgacagaaacagggctagaat

SEQ ID NO: 10043588 - DNA, 22 bp, Homo sapiens
gtgacaatattagctcaggggc

SEQ ID NO: 10043589 - DNA, 22 bp, Homo sapiens
gtggaggagaggcgccttgcgg

SEQ ID NO: 10043590 - DNA, 22 bp, Homo sapiens
gtggcagagttgctgactagaa

SEQ ID NO: 10043591 - DNA, 22 bp, Homo sapiens
gtggcaagatgactactcactg

SEQ ID NO: 10043592 - DNA, 22 bp, Homo sapiens
gtatatatcggcactattttaa

SEQ ID NO: 10043593 - DNA, 22 bp, Homo sapiens
gtatatatgtgtgaacatgtat

SEQ ID NO: 10043594 - DNA, 22 bp, Homo sapiens
gtatatatgtgtgaacatgtat

SEQ ID NO: 10043595 - DNA, 22 bp, Homo sapiens
gtacattctgtggacttggaca

SEQ ID NO: 10043596 - DNA, 22 bp, Homo sapiens
gggtgggcctgtctggccatgt

SEQ ID NO: 10043597 - DNA, 22 bp, Homo sapiens
gtccttccccagccagctctgg

SEQ ID NO: 10043598 - DNA, 22 bp, Homo sapiens
gtctgcacgtgccagggagggg

SEQ ID NO: 10043599 - DNA, 22 bp, Homo sapiens
gtctgcacggggaggatgggct

SEQ ID NO: 10043600 - DNA, 22 bp, Homo sapiens
gtcctgtgtaagtacttgctca

SEQ ID NO: 10043601 - DNA, 22 bp, Homo sapiens
gtcaggagagatcaggacagca

SEQ ID NO: 10043602 - DNA, 22 bp, Homo sapiens
gtcaggccctggcagccgtgac

SEQ ID NO: 10043603 - DNA, 22 bp, Homo sapiens
gtcaggccaatactctccagca

SEQ ID NO: 10043604 - DNA, 21 bp, Homo sapiens
gtcaggcccatagcagtgcct

SEQ ID NO: 10043605 - DNA, 17 bp, Homo sapiens
gctctgccaggaaagag

SEQ ID NO: 10043606 - DNA, 22 bp, Homo sapiens
gctgagagtgggtgcagtgctt

SEQ ID NO: 10043607 - DNA, 22 bp, Homo sapiens
gctccagctcgtggctcccagc

SEQ ID NO: 10043608 - DNA, 22 bp, Homo sapiens
gctccagctccggctccgaagc

SEQ ID NO: 10043609 - DNA, 22 bp, Homo sapiens
gctcatgactgtaatcccagca

SEQ ID NO: 10043610 - DNA, 21 bp, Homo sapiens
gctgctcgagatccagtgctt

SEQ ID NO: 10043611 - DNA, 17 bp, Homo sapiens
gcctctgcttgtgtcat

SEQ ID NO: 10043612 - DNA, 20 bp, Homo sapiens
gcctgcctcagctagctgag

SEQ ID NO: 10043613 - DNA, 18 bp, Homo sapiens
gcctgcctagagcttgcc

SEQ ID NO: 10043614 - DNA, 22 bp, Homo sapiens
gcctgcctgctgtcatctgcct

SEQ ID NO: 10043615 - DNA, 19 bp, Homo sapiens
gcctgcctgggtttctgag

SEQ ID NO: 10043616 - DNA, 22 bp, Homo sapiens
gcctgcctgttggctgaggtgc

SEQ ID NO: 10043617 - DNA, 22 bp, Homo sapiens
gcctgccttcggtgcgcagcgg

SEQ ID NO: 10043618 - DNA, 22 bp, Homo sapiens
gcctggagcctcagcaaggagg

SEQ ID NO: 10043619 - DNA, 22 bp, Homo sapiens
gcctggagggatagaatgcaag

SEQ ID NO: 10043620 - DNA, 22 bp, Homo sapiens
gcctgcttcctagccttccaag

SEQ ID NO: 10043621 - DNA, 22 bp, Homo sapiens
gcctgccttttggaggcacatt

SEQ ID NO: 10043622 - DNA, 22 bp, Homo sapiens
gcctgggaaatggtggggtcag

SEQ ID NO: 10043623 - DNA, 21 bp, Homo sapiens
gcctgggaaatctgggaagcc

SEQ ID NO: 10043624 - DNA, 22 bp, Homo sapiens
gcctgggaaagagtagggaaat

SEQ ID NO: 10043625 - DNA, 22 bp, Homo sapiens
gcctggagtagcatggcaagcc

SEQ ID NO: 10043626 - DNA, 22 bp, Homo sapiens
gcctgggaagactaagtgggag

SEQ ID NO: 10043627 - DNA, 22 bp, Homo sapiens
gcctgggaactctgatctcctg

SEQ ID NO: 10043628 - DNA, 21 bp, Homo sapiens
gcctgggaagagaaaggtaag

SEQ ID NO: 10043629 - DNA, 22 bp, Homo sapiens
gcctgggacccttagctcttgg

SEQ ID NO: 10043630 - DNA, 23 bp, Homo sapiens
gcctgggactcaggaggagctca

SEQ ID NO: 10043631 - DNA, 23 bp, Homo sapiens
gcctgggactggtagtgtgacct

SEQ ID NO: 10043632 - DNA, 22 bp, Homo sapiens
gcctgggactggatgtgtttgt

SEQ ID NO: 10043633 - DNA, 22 bp, Homo sapiens
gcctgggactgcagatccccag

SEQ ID NO: 10043634 - DNA, 19 bp, Homo sapiens
gcctgggatgggcagaact

SEQ ID NO: 10043635 - DNA, 21 bp, Homo sapiens
gcctgggatagtggcctccgg

SEQ ID NO: 10043636 - DNA, 22 bp, Homo sapiens
gcctgggatagaggcaatgcat

SEQ ID NO: 10043637 - DNA, 22 bp, Homo sapiens
gcctgggagaatgacctccaac

SEQ ID NO: 10043638 - DNA, 18 bp, Homo sapiens
gcctgggagaagtttcac

SEQ ID NO: 10043639 - DNA, 22 bp, Homo sapiens
gcctgggattcccagaggggca

SEQ ID NO: 10043640 - DNA, 20 bp, Homo sapiens
gcctgggattatccactggt

SEQ ID NO: 10043641 - DNA, 22 bp, Homo sapiens
gcctgggattctcaaaggggtg

SEQ ID NO: 10043642 - DNA, 22 bp, Homo sapiens
gcctgggattgtgtaagtgaat

SEQ ID NO: 10043643 - DNA, 22 bp, Homo sapiens
gcctgttgggtaacagagttca

SEQ ID NO: 10043644 - DNA, 22 bp, Homo sapiens
gccatgtcctgggcatctgcca

SEQ ID NO: 10043645 - DNA, 22 bp, Homo sapiens
gccatatacccactgtctccat

SEQ ID NO: 10043646 - DNA, 22 bp, Homo sapiens
gcccaggctggagtgcagtggc

SEQ ID NO: 10043647 - DNA, 22 bp, Homo sapiens
gccctctcttctgcagcctcca

SEQ ID NO: 10043648 - DNA, 22 bp, Homo sapiens
gcctctgcggagctgtacatca

SEQ ID NO: 10043649 - DNA, 22 bp, Homo sapiens
gcctctgctcggactttgcctc

SEQ ID NO: 10043650 - DNA, 22 bp, Homo sapiens
gcctctgcggggcccgagcccg

SEQ ID NO: 10043651 - DNA, 22 bp, Homo sapiens
gcctctgccctcctgggactgc

SEQ ID NO: 10043652 - DNA, 22 bp, Homo sapiens
gcctctgcccatccaccatcag

SEQ ID NO: 10043653 - DNA, 22 bp, Homo sapiens
gcctctgcgcctcagccgacct

SEQ ID NO: 10043654 - DNA, 22 bp, Homo sapiens
gcctctgctgcaagcctggttg

SEQ ID NO: 10043655 - DNA, 19 bp, Homo sapiens
gcctctgctggggacaggc

SEQ ID NO: 10043656 - DNA, 21 bp, Homo sapiens
gcctctgctgtcttattgtga

SEQ ID NO: 10043657 - DNA, 22 bp, Homo sapiens
gcctctgctgacaagatggaca

SEQ ID NO: 10043658 - DNA, 22 bp, Homo sapiens
gcctctgctctcaggtagcctc

SEQ ID NO: 10043659 - DNA, 23 bp, Homo sapiens
gcctctgctctgcgttggggact

SEQ ID NO: 10043660 - DNA, 22 bp, Homo sapiens
gcctctgcaccagtactgtgcc

SEQ ID NO: 10043661 - DNA, 22 bp, Homo sapiens
gcctctgcactgtggcacacca

SEQ ID NO: 10043662 - DNA, 23 bp, Homo sapiens
gcctctgcagcctagttagtgtc

SEQ ID NO: 10043663 - DNA, 22 bp, Homo sapiens
gcctctgcaggtgcggttatcc

SEQ ID NO: 10043664 - DNA, 22 bp, Homo sapiens
gcctctgcaattacattgtgcc

SEQ ID NO: 10043665 - DNA, 22 bp, Homo sapiens
gcctctgcaactccgccttggt

SEQ ID NO: 10043666 - DNA, 22 bp, Homo sapiens
gcctctgccaagggggctgcgg

SEQ ID NO: 10043667 - DNA, 22 bp, Homo sapiens
gcctctgcatgctcagcaccca

SEQ ID NO: 10043668 - DNA, 22 bp, Homo sapiens
gcctctgcatcatcactccagc

SEQ ID NO: 10043669 - DNA, 22 bp, Homo sapiens
gcctctgcatcttcgccgcact

SEQ ID NO: 10043670 - DNA, 22 bp, Homo sapiens
gcctcctggttgcttctccaac

SEQ ID NO: 10043671 - DNA, 22 bp, Homo sapiens
gccacagcccgagcaccatgag

SEQ ID NO: 10043672 - DNA, 22 bp, Homo sapiens
gccagcagccacagaagtcact

SEQ ID NO: 10043673 - DNA, 22 bp, Homo sapiens
gccacagcggggccgctagagc

SEQ ID NO: 10043674 - DNA, 22 bp, Homo sapiens
gccacagctcacgttccccatt

SEQ ID NO: 10043675 - DNA, 22 bp, Homo sapiens
gcaggtggtccccgtggagtgg

SEQ ID NO: 10043676 - DNA, 22 bp, Homo sapiens
gcagggtgatagtgaggctcag

SEQ ID NO: 10043677 - DNA, 22 bp, Homo sapiens
gcagggtggatggcagggccag

SEQ ID NO: 10043678 - DNA, 22 bp, Homo sapiens
gcagggtgccgacttcagggat

SEQ ID NO: 10043679 - DNA, 22 bp, Homo sapiens
gcaggtggagcagtagtctggt

SEQ ID NO: 10043680 - DNA, 22 bp, Homo sapiens
gcagtggggaatgctggggaga

SEQ ID NO: 10043681 - DNA, 22 bp, Homo sapiens
gcagtggggaatgctggggaga

SEQ ID NO: 10043682 - DNA, 22 bp, Homo sapiens
gcagtagcagcctagatgccat

SEQ ID NO: 10043683 - DNA, 22 bp, Homo sapiens
gcagtgggcaacaagagctgga

SEQ ID NO: 10043684 - DNA, 22 bp, Homo sapiens
gcaggggctgctgggaactcgg

SEQ ID NO: 10043685 - DNA, 22 bp, Homo sapiens
gcagcctctgcagttcaggagg

SEQ ID NO: 10043686 - DNA, 22 bp, Homo sapiens
gcagagcctgtgtctgagcaaa

SEQ ID NO: 10043687 - DNA, 22 bp, Homo sapiens
gcacaagggtggtctctggagc

SEQ ID NO: 10043688 - DNA, 22 bp, Homo sapiens
gcacccagtttgtctcagggtt

SEQ ID NO: 10043689 - DNA, 22 bp, Homo sapiens
gcacccagggcaggaagtgagg

SEQ ID NO: 10043690 - DNA, 22 bp, Homo sapiens
gcacccagggacttggctggcc

SEQ ID NO: 10043691 - DNA, 22 bp, Homo sapiens
gcacccaggcttgggcagcaac

SEQ ID NO: 10043692 - DNA, 22 bp, Homo sapiens
gcacccaggccggcgactgcag

SEQ ID NO: 10043693 - DNA, 19 bp, Homo sapiens
gcaccctgaggtcatggcc

SEQ ID NO: 10043694 - DNA, 22 bp, Homo sapiens
gcaccctgagtgttcagctcca

SEQ ID NO: 10043695 - DNA, 22 bp, Homo sapiens
gcaccctgctctatccttgcta

SEQ ID NO: 10043696 - DNA, 19 bp, Homo sapiens
gcaccctggccactcccac

SEQ ID NO: 10043697 - DNA, 22 bp, Homo sapiens
gcaccctgtttatcctgagttc

SEQ ID NO: 10043698 - DNA, 22 bp, Homo sapiens
gcaccctctgagctccgctccg

SEQ ID NO: 10043699 - DNA, 22 bp, Homo sapiens
gcacctcattttgcaggtagaa

SEQ ID NO: 10043700 - DNA, 22 bp, Homo sapiens
gcagaagcccggtcagcgcacg

SEQ ID NO: 10043701 - DNA, 22 bp, Homo sapiens
gcacaacaccaagggaggtatc

SEQ ID NO: 10043702 - DNA, 22 bp, Homo sapiens
gattctttggcctttattgaca

SEQ ID NO: 10043703 - DNA, 18 bp, Homo sapiens
gatgggagcaagagaaga

SEQ ID NO: 10043704 - DNA, 22 bp, Homo sapiens
gatggtgcaggtgaagtgctgg

SEQ ID NO: 10043705 - DNA, 17 bp, Homo sapiens
gatggggctgacatcag

SEQ ID NO: 10043706 - DNA, 22 bp, Homo sapiens
gagtccaagctagagccactca

SEQ ID NO: 10043707 - DNA, 22 bp, Homo sapiens
gagtcaggctagggtgacaggc

SEQ ID NO: 10043708 - DNA, 22 bp, Homo sapiens
gaggtatggatatctggagagg

SEQ ID NO: 10043709 - DNA, 22 bp, Homo sapiens
gagggccaatggatttcaactg

SEQ ID NO: 10043710 - DNA, 22 bp, Homo sapiens
gagggatggtagttgacactga

SEQ ID NO: 10043711 - DNA, 22 bp, Homo sapiens
gagctggaggaccaggactggg

SEQ ID NO: 10043712 - DNA, 22 bp, Homo sapiens
gagctggaggcagtgctgaggt

SEQ ID NO: 10043713 - DNA, 23 bp, Homo sapiens
gaggcagctcctgcagtgccctg

SEQ ID NO: 10043714 - DNA, 22 bp, Homo sapiens
gaggcctctgtcccgccaggga

SEQ ID NO: 10043715 - DNA, 22 bp, Homo sapiens
gaggcctctgtcccaccaggga

SEQ ID NO: 10043716 - DNA, 22 bp, Homo sapiens
gaggagggttggccttaggtag

SEQ ID NO: 10043717 - DNA, 22 bp, Homo sapiens
gaggagggttggccttaggtag

SEQ ID NO: 10043718 - DNA, 22 bp, Homo sapiens
gaggaggcttccgggaggcacg

SEQ ID NO: 10043719 - DNA, 22 bp, Homo sapiens
gaggaggcttccgggaggcacg

SEQ ID NO: 10043720 - DNA, 22 bp, Homo sapiens
gaggaggctgtttctctgcatt

SEQ ID NO: 10043721 - DNA, 22 bp, Homo sapiens
gaggagggagaattaggcttaa

SEQ ID NO: 10043722 - DNA, 22 bp, Homo sapiens
gaggagggagctggaagctctt

SEQ ID NO: 10043723 - DNA, 23 bp, Homo sapiens
gaggagggtctgacaagtgtagc

SEQ ID NO: 10043724 - DNA, 22 bp, Homo sapiens
gaggagggagctggaagctctt

SEQ ID NO: 10043725 - DNA, 22 bp, Homo sapiens
gagttaaaagccctctcagcag

SEQ ID NO: 10043726 - DNA, 22 bp, Homo sapiens
gagtggggggtccgtctcagtg

SEQ ID NO: 10043727 - DNA, 22 bp, Homo sapiens
gagtggggtctgggcatcagtc

SEQ ID NO: 10043728 - DNA, 22 bp, Homo sapiens
gataaaataactatggaatact

SEQ ID NO: 10043729 - DNA, 22 bp, Homo sapiens
gataaaagaggaaatttgttca

SEQ ID NO: 10043730 - DNA, 23 bp, Homo sapiens
gagtttcttccaggagccctggg

SEQ ID NO: 10043731 - DNA, 22 bp, Homo sapiens
gataaattgcactttttcttac

SEQ ID NO: 10043732 - DNA, 21 bp, Homo sapiens
gataaaatgggccttggtcct

SEQ ID NO: 10043733 - DNA, 22 bp, Homo sapiens
gagtgccaagagaagaggctgg

SEQ ID NO: 10043734 - DNA, 22 bp, Homo sapiens
gagtggggctttaaaggctcag

SEQ ID NO: 10043735 - DNA, 22 bp, Homo sapiens
gagtggagcaaaagaggtagat

SEQ ID NO: 10043736 - DNA, 22 bp, Homo sapiens
gagtgcaatgtagacatcaggg

SEQ ID NO: 10043737 - DNA, 22 bp, Homo sapiens
gatgagaaggctcagatccaaa

SEQ ID NO: 10043738 - DNA, 22 bp, Homo sapiens
gatgagaaatggacaggagtgg

SEQ ID NO: 10043739 - DNA, 22 bp, Homo sapiens
gatatacaatccacagttgatt

SEQ ID NO: 10043740 - DNA, 18 bp, Homo sapiens
gatatataggaggaaagt

SEQ ID NO: 10043741 - DNA, 22 bp, Homo sapiens
gatatacagagcattctttgat

SEQ ID NO: 10043742 - DNA, 22 bp, Homo sapiens
gatatacataggtttctatgca

SEQ ID NO: 10043743 - DNA, 22 bp, Homo sapiens
cttgggaggagaacaaagctcc

SEQ ID NO: 10043744 - DNA, 22 bp, Homo sapiens
cttcttttacaggtcttgggtt

SEQ ID NO: 10043745 - DNA, 22 bp, Homo sapiens
cttcttttgaagggcgttgtgt

SEQ ID NO: 10043746 - DNA, 22 bp, Homo sapiens
cttcttttcatggcttgggaag

SEQ ID NO: 10043747 - DNA, 22 bp, Homo sapiens
cttctcttcctttgtcaactga

SEQ ID NO: 10043748 - DNA, 22 bp, Homo sapiens
cttctcagttgcaagtgtcaga

SEQ ID NO: 10043749 - DNA, 22 bp, Homo sapiens
gaacactgtttcttcgtgaaca

SEQ ID NO: 10043750 - DNA, 22 bp, Homo sapiens
gaacactgctgttgggttctga

SEQ ID NO: 10043751 - DNA, 22 bp, Homo sapiens
gaacactggggtatcattgagc

SEQ ID NO: 10043752 - DNA, 22 bp, Homo sapiens
gaacactgctgttgggttctga

SEQ ID NO: 10043753 - DNA, 22 bp, Homo sapiens
gaacactgaggacactgagaat

SEQ ID NO: 10043754 - DNA, 22 bp, Homo sapiens
gaacactgagagagatgggcag

SEQ ID NO: 10043755 - DNA, 22 bp, Homo sapiens
gaacactgagaaagtcagcttt

SEQ ID NO: 10043756 - DNA, 22 bp, Homo sapiens
gaacactgacattttcctgact

SEQ ID NO: 10043757 - DNA, 22 bp, Homo sapiens
gaacactgagaaagtcagcttt

SEQ ID NO: 10043758 - DNA, 22 bp, Homo sapiens
gaaagggcatgggcatgacaac

SEQ ID NO: 10043759 - DNA, 22 bp, Homo sapiens
gaaaggccaccatgccagggac

SEQ ID NO: 10043760 - DNA, 22 bp, Homo sapiens
gaaaggccacgtgccaagatta

SEQ ID NO: 10043761 - DNA, 22 bp, Homo sapiens
gaaaggccagctcacagatgag

SEQ ID NO: 10043762 - DNA, 22 bp, Homo sapiens
gaaaggccatttctgagggttt

SEQ ID NO: 10043763 - DNA, 22 bp, Homo sapiens
gaaagggagtgaagatggtata

SEQ ID NO: 10043764 - DNA, 21 bp, Homo sapiens
gaaaagcaagggagtagaaca

SEQ ID NO: 10043765 - DNA, 22 bp, Homo sapiens
gacttcaaagcgtgataaagat

SEQ ID NO: 10043766 - DNA, 17 bp, Homo sapiens
gacttcaacttctgctg

SEQ ID NO: 10043767 - DNA, 22 bp, Homo sapiens
gacaggcagacctgtgccctgg

SEQ ID NO: 10043768 - DNA, 22 bp, Homo sapiens
gacaggaggcagagctcaggtg

SEQ ID NO: 10043769 - DNA, 22 bp, Homo sapiens
gagacagagtgttttttaaggt

SEQ ID NO: 10043770 - DNA, 22 bp, Homo sapiens
gacaggaacataaatgtaggag

SEQ ID NO: 10043771 - DNA, 20 bp, Homo sapiens
gacaggagagttaggtaggt

SEQ ID NO: 10043772 - DNA, 22 bp, Homo sapiens
gaattagtgttgaaatcagggc

SEQ ID NO: 10043773 - DNA, 22 bp, Homo sapiens
gaaggccctgttttccctattt

SEQ ID NO: 10043774 - DNA, 22 bp, Homo sapiens
gaaggcccgccctgagcaaggg

SEQ ID NO: 10043775 - DNA, 22 bp, Homo sapiens
gaaggccctggtattcttgagg

SEQ ID NO: 10043776 - DNA, 22 bp, Homo sapiens
gaaggcccagtcaaggggctag

SEQ ID NO: 10043777 - DNA, 22 bp, Homo sapiens
ctcagcagtaaacgtccggaac

SEQ ID NO: 10043778 - DNA, 22 bp, Homo sapiens
ttgacttgaagctgtggaaaaa

SEQ ID NO: 10043779 - DNA, 22 bp, Homo sapiens
ctcagcaggtaccacatgatct

SEQ ID NO: 10043780 - DNA, 22 bp, Homo sapiens
ctcagcaggtcttgggtagggg

SEQ ID NO: 10043781 - DNA, 22 bp, Homo sapiens
ctcagcaggcactgtgccttac

SEQ ID NO: 10043782 - DNA, 17 bp, Homo sapiens
ctcagcagggctcactt

SEQ ID NO: 10043783 - DNA, 22 bp, Homo sapiens
ctcagcagagaccagggaggaa

SEQ ID NO: 10043784 - DNA, 22 bp, Homo sapiens
ctcagcagctgctgctggtggg

SEQ ID NO: 10043785 - DNA, 22 bp, Homo sapiens
ctcagcagcagggaagaggtca

SEQ ID NO: 10043786 - DNA, 22 bp, Homo sapiens
ctattttctgtctctatagagt

SEQ ID NO: 10043787 - DNA, 22 bp, Homo sapiens
ctatttggatgttagcctcagt

SEQ ID NO: 10043788 - DNA, 22 bp, Homo sapiens
ctatttggggtagaagatggat

SEQ ID NO: 10043789 - DNA, 22 bp, Homo sapiens
ctatttggccaagctgcccaca

SEQ ID NO: 10043790 - DNA, 19 bp, Homo sapiens
ttcattctcttattgttgt

SEQ ID NO: 10043791 - DNA, 22 bp, Homo sapiens
ctctcccttgggtgggctttgg

SEQ ID NO: 10043792 - DNA, 22 bp, Homo sapiens
ctctccctggccagctgtgcag

SEQ ID NO: 10043793 - DNA, 22 bp, Homo sapiens
ctctccctaggttagcggtcag

SEQ ID NO: 10043794 - DNA, 22 bp, Homo sapiens
ctctccctcattgggttccatt

SEQ ID NO: 10043795 - DNA, 22 bp, Homo sapiens
tttaaaaaactagtctgagtct

SEQ ID NO: 10043796 - DNA, 22 bp, Homo sapiens
ttgggcaggctggcagactgct

SEQ ID NO: 10043797 - DNA, 22 bp, Homo sapiens
ctctttggttaatcacacagat

SEQ ID NO: 10043798 - DNA, 22 bp, Homo sapiens
ctctttggccagaaaatgtttt

SEQ ID NO: 10043799 - DNA, 22 bp, Homo sapiens
ctctttggcccccgatgattca

SEQ ID NO: 10043800 - DNA, 22 bp, Homo sapiens
ctgcagaaagctgagatgatta

SEQ ID NO: 10043801 - DNA, 22 bp, Homo sapiens
ctgcagcaagagaagtgctgac

SEQ ID NO: 10043802 - DNA, 22 bp, Homo sapiens
ctggcacatagtaggtgcacag

SEQ ID NO: 10043803 - DNA, 22 bp, Homo sapiens
ctggcacatagtcagcactcaa

SEQ ID NO: 10043804 - DNA, 22 bp, Homo sapiens
ctggcacatgtgagccacatca

SEQ ID NO: 10043805 - DNA, 22 bp, Homo sapiens
ctggcatgaaatggcatctcat

SEQ ID NO: 10043806 - DNA, 22 bp, Homo sapiens
ctggccaggcggcccctgcatg

SEQ ID NO: 10043807 - DNA, 22 bp, Homo sapiens
ctggccagtgcctgtgggcccc

SEQ ID NO: 10043808 - DNA, 22 bp, Homo sapiens
ctggctccctggacatggggcc

SEQ ID NO: 10043809 - DNA, 22 bp, Homo sapiens
ctggctccctctccctgagtca

SEQ ID NO: 10043810 - DNA, 22 bp, Homo sapiens
ctggcccaggagagcaggcatt

SEQ ID NO: 10043811 - DNA, 22 bp, Homo sapiens
ctggcccaggaagacgtgtccc

SEQ ID NO: 10043812 - DNA, 22 bp, Homo sapiens
ctggcccagagctctggccttt

SEQ ID NO: 10043813 - DNA, 22 bp, Homo sapiens
ctggcccaggctcctggggcac

SEQ ID NO: 10043814 - DNA, 20 bp, Homo sapiens
ctggcccaggatgatggcgc

SEQ ID NO: 10043815 - DNA, 21 bp, Homo sapiens
ctggcccagggatctgcattt

SEQ ID NO: 10043816 - DNA, 22 bp, Homo sapiens
ctggcccaggctcctggggcac

SEQ ID NO: 10043817 - DNA, 23 bp, Homo sapiens
ctggcccaggtgagaggttggtg

SEQ ID NO: 10043818 - DNA, 22 bp, Homo sapiens
ctggccatgttgcctctgagac

SEQ ID NO: 10043819 - DNA, 22 bp, Homo sapiens
ctggcccagagagcagagctta

SEQ ID NO: 10043820 - DNA, 22 bp, Homo sapiens
ctggacatttcgcacccttcca

SEQ ID NO: 10043821 - DNA, 22 bp, Homo sapiens
ctggaggaccacagaagctggt

SEQ ID NO: 10043822 - DNA, 22 bp, Homo sapiens
ctggaaaatgaagaagcagagg

SEQ ID NO: 10043823 - DNA, 22 bp, Homo sapiens
ctggaagtggagagtggccctc

SEQ ID NO: 10043824 - DNA, 23 bp, Homo sapiens
ctggaagtgcttttatagctttg

SEQ ID NO: 10043825 - DNA, 22 bp, Homo sapiens
cctggccatagggcccaggaaa

SEQ ID NO: 10043826 - DNA, 22 bp, Homo sapiens
cctggccatttgaacttcagac

SEQ ID NO: 10043827 - DNA, 22 bp, Homo sapiens
cctggccagctaattgcccatc

SEQ ID NO: 10043828 - DNA, 22 bp, Homo sapiens
cctggccagcgccggctgctcg

SEQ ID NO: 10043829 - DNA, 22 bp, Homo sapiens
cctggccaggcatggagtcaca

SEQ ID NO: 10043830 - DNA, 22 bp, Homo sapiens
cctggccagggtctgggctgct

SEQ ID NO: 10043831 - DNA, 22 bp, Homo sapiens
cctggccagtttccaggccctg

SEQ ID NO: 10043832 - DNA, 19 bp, Homo sapiens
cctggccctgctgcgcggg

SEQ ID NO: 10043833 - DNA, 22 bp, Homo sapiens
tggtcccattgttctgcccagg

SEQ ID NO: 10043834 - DNA, 18 bp, Homo sapiens
tggtccagttcagatata

SEQ ID NO: 10043835 - DNA, 22 bp, Homo sapiens
tggtccagtcgttcctttcctt

SEQ ID NO: 10043836 - DNA, 22 bp, Homo sapiens
tggtccagtaagggtggagaga

SEQ ID NO: 10043837 - DNA, 22 bp, Homo sapiens
tggtgctgccacctcctctgct

SEQ ID NO: 10043838 - DNA, 22 bp, Homo sapiens
tggtgctgccaggctcctgcca

SEQ ID NO: 10043839 - DNA, 22 bp, Homo sapiens
tggtgctgcaggtgggcacagt

SEQ ID NO: 10043840 - DNA, 22 bp, Homo sapiens
tgtattatcaagtaaatacatg

SEQ ID NO: 10043841 - DNA, 22 bp, Homo sapiens
cctggaggtggaggttgcagtg

SEQ ID NO: 10043842 - DNA, 21 bp, Homo sapiens
cctgggagatcagctgccttc

SEQ ID NO: 10043843 - DNA, 22 bp, Homo sapiens
tgtgcccagactgcctcagtga

SEQ ID NO: 10043844 - DNA, 22 bp, Homo sapiens
tgtgcccatccctctggagtgt

SEQ ID NO: 10043845 - DNA, 22 bp, Homo sapiens
tgtgccaggccctggggaccaa

SEQ ID NO: 10043846 - DNA, 21 bp, Homo sapiens
tgtgccagggatggggagccc

SEQ ID NO: 10043847 - DNA, 22 bp, Homo sapiens
tgtctttctatctctagattta

SEQ ID NO: 10043848 - DNA, 22 bp, Homo sapiens
tgtctttctgcaccacctcaca

SEQ ID NO: 10043849 - DNA, 22 bp, Homo sapiens
tgtctttagcccatatagactt

SEQ ID NO: 10043850 - DNA, 22 bp, Homo sapiens
cctgggcctcacccagctcttg

SEQ ID NO: 10043851 - DNA, 22 bp, Homo sapiens
cctgggtgaaatagtcctcaag

SEQ ID NO: 10043852 - DNA, 22 bp, Homo sapiens
cctggggctcaagatggcgccg

SEQ ID NO: 10043853 - DNA, 22 bp, Homo sapiens
cctgggagctgtggaaaggctg

SEQ ID NO: 10043854 - DNA, 22 bp, Homo sapiens
tgtgcttttctctgctcctgga

SEQ ID NO: 10043855 - DNA, 23 bp, Homo sapiens
cctgggcattggctgcagcttct

SEQ ID NO: 10043856 - DNA, 22 bp, Homo sapiens
tgctctggagtggcttgtgcac

SEQ ID NO: 10043857 - DNA, 22 bp, Homo sapiens
tgcctgggagtgaccaagactc

SEQ ID NO: 10043858 - DNA, 22 bp, Homo sapiens
tgcctgggccttcccacctctg

SEQ ID NO: 10043859 - DNA, 22 bp, Homo sapiens
tgcctgggacatgctgtggact

SEQ ID NO: 10043860 - DNA, 22 bp, Homo sapiens
tgcctgggactgtactaaattt

SEQ ID NO: 10043861 - DNA, 22 bp, Homo sapiens
cccccaggctctgacacaggag

SEQ ID NO: 10043862 - DNA, 22 bp, Homo sapiens
cccccaggggctccgcctcgtg

SEQ ID NO: 10043863 - DNA, 22 bp, Homo sapiens
ccctaggaattctatggccaag

SEQ ID NO: 10043864 - DNA, 22 bp, Homo sapiens
cccctctccctcacttatcaat

SEQ ID NO: 10043865 - DNA, 22 bp, Homo sapiens
ccccagccagcaggacctctga

SEQ ID NO: 10043866 - DNA, 22 bp, Homo sapiens
ccccagccagcttgtagtagaa

SEQ ID NO: 10043867 - DNA, 22 bp, Homo sapiens
ccccagccttccatgggaattg

SEQ ID NO: 10043868 - DNA, 22 bp, Homo sapiens
ccccagcccacaagcatattaa

SEQ ID NO: 10043869 - DNA, 22 bp, Homo sapiens
cccaggaggtgtagctgcgtgg

SEQ ID NO: 10043870 - DNA, 22 bp, Homo sapiens
cccaggaaacccgaaggcgacc

SEQ ID NO: 10043871 - DNA, 22 bp, Homo sapiens
cctctcccgggtgccgctgggc

SEQ ID NO: 10043872 - DNA, 20 bp, Homo sapiens
tggcccagtggggcagggtg

SEQ ID NO: 10043873 - DNA, 22 bp, Homo sapiens
tggccccattttacagatgaaa

SEQ ID NO: 10043874 - DNA, 20 bp, Homo sapiens
tggcccagtggggcagggtg

SEQ ID NO: 10043875 - DNA, 22 bp, Homo sapiens
tggcccagtgcttatgctctga

SEQ ID NO: 10043876 - DNA, 22 bp, Homo sapiens
tggcccagtgcttatgctctga

SEQ ID NO: 10043877 - DNA, 22 bp, Homo sapiens
tggcccagcagttctgccccag

SEQ ID NO: 10043878 - DNA, 18 bp, Homo sapiens
tggccccttatcagtcct

SEQ ID NO: 10043879 - DNA, 22 bp, Homo sapiens
tggcccctggcacacggaggat

SEQ ID NO: 10043880 - DNA, 22 bp, Homo sapiens
tggcccgacctctgctcatgca

SEQ ID NO: 10043881 - DNA, 22 bp, Homo sapiens
tggcccctgaggagcgtcagcc

SEQ ID NO: 10043882 - DNA, 22 bp, Homo sapiens
tggcccctgaggagcatcagcc

SEQ ID NO: 10043883 - DNA, 22 bp, Homo sapiens
tggccctgctggacacgcctgc

SEQ ID NO: 10043884 - DNA, 22 bp, Homo sapiens
tggccctgctatgatcctgcaa

SEQ ID NO: 10043885 - DNA, 22 bp, Homo sapiens
tggccctgccgccacgacgtct

SEQ ID NO: 10043886 - DNA, 22 bp, Homo sapiens
tggccctgctatgatcctgcaa

SEQ ID NO: 10043887 - DNA, 22 bp, Homo sapiens
tggccctgctgtatcatctgct

SEQ ID NO: 10043888 - DNA, 22 bp, Homo sapiens
tggccctgctggccaaaggcta

SEQ ID NO: 10043889 - DNA, 22 bp, Homo sapiens
tggccctgctgggtcagagctg

SEQ ID NO: 10043890 - DNA, 22 bp, Homo sapiens
tggctcagtttctgcccagctg

SEQ ID NO: 10043891 - DNA, 22 bp, Homo sapiens
cctccctgtctacctgttgtgg

SEQ ID NO: 10043892 - DNA, 22 bp, Homo sapiens
cctccctgtctacctgttgtgg

SEQ ID NO: 10043893 - DNA, 22 bp, Homo sapiens
ccctggagaggactcacccctg

SEQ ID NO: 10043894 - DNA, 20 bp, Homo sapiens
ccctggagagaagctccacg

SEQ ID NO: 10043895 - DNA, 22 bp, Homo sapiens
ccctggagatcgggagaggaag

SEQ ID NO: 10043896 - DNA, 22 bp, Homo sapiens
ccctccagccatggacccaggt

SEQ ID NO: 10043897 - DNA, 20 bp, Homo sapiens
ccctggcctgtttcatgccc

SEQ ID NO: 10043898 - DNA, 22 bp, Homo sapiens
ccctggatttacatcattctga

SEQ ID NO: 10043899 - DNA, 23 bp, Homo sapiens
ccctggccttggggcacaggctg

SEQ ID NO: 10043900 - DNA, 22 bp, Homo sapiens
cctaggccgcccggtgcgtggg

SEQ ID NO: 10043901 - DNA, 20 bp, Homo sapiens
cctaggccctccggctgccc

SEQ ID NO: 10043902 - DNA, 22 bp, Homo sapiens
tggcagcttgaatgcagtcttt

SEQ ID NO: 10043903 - DNA, 22 bp, Homo sapiens
tggcaaggctgtgggggcagag

SEQ ID NO: 10043904 - DNA, 22 bp, Homo sapiens
tggcacaggagcactgccctgg

SEQ ID NO: 10043905 - DNA, 22 bp, Homo sapiens
cagctttgagagttgcatttta

SEQ ID NO: 10043906 - DNA, 22 bp, Homo sapiens
cagctttgagcagccagtggca

SEQ ID NO: 10043907 - DNA, 22 bp, Homo sapiens
cagctttgacctaaagtaggaa

SEQ ID NO: 10043908 - DNA, 22 bp, Homo sapiens
cagctttgaaacatggctctag

SEQ ID NO: 10043909 - DNA, 22 bp, Homo sapiens
cagctttgattcactgcctagt

SEQ ID NO: 10043910 - DNA, 22 bp, Homo sapiens
cagctttaggactcataataaa

SEQ ID NO: 10043911 - DNA, 22 bp, Homo sapiens
cagctttagagaaaacatattt

SEQ ID NO: 10043912 - DNA, 21 bp, Homo sapiens
caggaaagaaaacgtacatat

SEQ ID NO: 10043913 - DNA, 22 bp, Homo sapiens
cagcttctcgggagcgcatgtg

SEQ ID NO: 10043914 - DNA, 22 bp, Homo sapiens
cagcttctccagatgaccctca

SEQ ID NO: 10043915 - DNA, 22 bp, Homo sapiens
cagcttcaccagggccatggtt

SEQ ID NO: 10043916 - DNA, 22 bp, Homo sapiens
gtttcctttaatagtgatattg

SEQ ID NO: 10043917 - DNA, 22 bp, Homo sapiens
gtttcctttctattgccttgat

SEQ ID NO: 10043918 - DNA, 19 bp, Homo sapiens
gtttccttgggtgtaggga

SEQ ID NO: 10043919 - DNA, 22 bp, Homo sapiens
gtttcctgatgtgggagatctt

SEQ ID NO: 10043920 - DNA, 22 bp, Homo sapiens
gttcttaaagattcatcaagca

SEQ ID NO: 10043921 - DNA, 22 bp, Homo sapiens
gttgctgattaacactttgagt

SEQ ID NO: 10043922 - DNA, 22 bp, Homo sapiens
gttgcttgttagtggtgaggtt

SEQ ID NO: 10043923 - DNA, 22 bp, Homo sapiens
caggaaaggtagtcacaatgta

SEQ ID NO: 10043924 - DNA, 22 bp, Homo sapiens
caggaaaggtgtgtcatgatgg

SEQ ID NO: 10043925 - DNA, 22 bp, Homo sapiens
caggaaagccgagtgccatagg

SEQ ID NO: 10043926 - DNA, 22 bp, Homo sapiens
caggaaagggatgggctgccac

SEQ ID NO: 10043927 - DNA, 22 bp, Homo sapiens
gtgggcagtggggtcttctgcc

SEQ ID NO: 10043928 - DNA, 22 bp, Homo sapiens
gtggcttcttctgccagaagga

SEQ ID NO: 10043929 - DNA, 22 bp, Homo sapiens
gtggcttctgcggtgtgcgcag

SEQ ID NO: 10043930 - DNA, 22 bp, Homo sapiens
cagctctgttcatagatggtgc

SEQ ID NO: 10043931 - DNA, 22 bp, Homo sapiens
gtggccagtcccgatgcttgtt

SEQ ID NO: 10043932 - DNA, 22 bp, Homo sapiens
cagctctgctggtggtgccagg

SEQ ID NO: 10043933 - DNA, 22 bp, Homo sapiens
gtggcagagatagaactggaat

SEQ ID NO: 10043934 - DNA, 22 bp, Homo sapiens
cagctgcagtgggggaccacaa

SEQ ID NO: 10043935 - DNA, 22 bp, Homo sapiens
cagctgcagtgggggaccacaa

SEQ ID NO: 10043936 - DNA, 18 bp, Homo sapiens
cagctgcaggctcaggac

SEQ ID NO: 10043937 - DNA, 22 bp, Homo sapiens
cagctgcaggctgtgcaggaag

SEQ ID NO: 10043938 - DNA, 22 bp, Homo sapiens
cagctgcaggagctgagcactt

SEQ ID NO: 10043939 - DNA, 22 bp, Homo sapiens
cagctgcaggagaaacagaggc

SEQ ID NO: 10043940 - DNA, 19 bp, Homo sapiens
cagctgcaccgtgaccatc

SEQ ID NO: 10043941 - DNA, 22 bp, Homo sapiens
cagctgcagaaagcaagcaggt

SEQ ID NO: 10043942 - DNA, 22 bp, Homo sapiens
gtggggctgagtggagccagaa

SEQ ID NO: 10043943 - DNA, 22 bp, Homo sapiens
gtggggctggaagatgggtact

SEQ ID NO: 10043944 - DNA, 22 bp, Homo sapiens
cagctgtctggggagtgctcgc

SEQ ID NO: 10043945 - DNA, 22 bp, Homo sapiens
taagcaaaagtcgagtgtgagc

SEQ ID NO: 10043946 - DNA, 22 bp, Homo sapiens
caggatggtgtgagtgtgagga

SEQ ID NO: 10043947 - DNA, 22 bp, Homo sapiens
caggcacagctgggcaattgcg

SEQ ID NO: 10043948 - DNA, 22 bp, Homo sapiens
caggcacagtgttgctgttcaa

SEQ ID NO: 10043949 - DNA, 22 bp, Homo sapiens
taacaatacccattctaattac

SEQ ID NO: 10043950 - DNA, 22 bp, Homo sapiens
caggatggagagtgaggggtca

SEQ ID NO: 10043951 - DNA, 22 bp, Homo sapiens
caggcagctctaatggaaagtg

SEQ ID NO: 10043952 - DNA, 22 bp, Homo sapiens
caggcagcatcagtctgctgta

SEQ ID NO: 10043953 - DNA, 22 bp, Homo sapiens
caggcagcatttactctgatga

SEQ ID NO: 10043954 - DNA, 22 bp, Homo sapiens
caggcagcagccactctggtat

SEQ ID NO: 10043955 - DNA, 22 bp, Homo sapiens
caggcagcaggagccctgctcg

SEQ ID NO: 10043956 - DNA, 22 bp, Homo sapiens
caggcagagacgtcagtgtagg

SEQ ID NO: 10043957 - DNA, 22 bp, Homo sapiens
caggcagagaactcatccgtga

SEQ ID NO: 10043958 - DNA, 22 bp, Homo sapiens
caggcagaaggaagtaccaggc

SEQ ID NO: 10043959 - DNA, 22 bp, Homo sapiens
taatttactcagatgttcaatc

SEQ ID NO: 10043960 - DNA, 22 bp, Homo sapiens
caggagggcccgagactcttcc

SEQ ID NO: 10043961 - DNA, 23 bp, Homo sapiens
caggagggaatgaagttagacaa

SEQ ID NO: 10043962 - DNA, 22 bp, Homo sapiens
caggaggcccggccacagccca

SEQ ID NO: 10043963 - DNA, 22 bp, Homo sapiens
caggagtgcaggtggtgaggca

SEQ ID NO: 10043964 - DNA, 22 bp, Homo sapiens
caggagtggcacccttttccct

SEQ ID NO: 10043965 - DNA, 22 bp, Homo sapiens
caggagtggtgtgagggactcc

SEQ ID NO: 10043966 - DNA, 22 bp, Homo sapiens
caggagtgagatgcgatcactt

SEQ ID NO: 10043967 - DNA, 22 bp, Homo sapiens
caggagtgagttggggtctaca

SEQ ID NO: 10043968 - DNA, 22 bp, Homo sapiens
caggagtgtcgggtcactaggt

SEQ ID NO: 10043969 - DNA, 22 bp, Homo sapiens
caggagtgtctccacacagcaa

SEQ ID NO: 10043970 - DNA, 22 bp, Homo sapiens
caggagtgtttgctacagtttc

SEQ ID NO: 10043971 - DNA, 22 bp, Homo sapiens
caggagtgttgattgctcagga

SEQ ID NO: 10043972 - DNA, 22 bp, Homo sapiens
taaagcagtgcaaaagcgtttt

SEQ ID NO: 10043973 - DNA, 22 bp, Homo sapiens
caggagcccgttgctccggcgg

SEQ ID NO: 10043974 - DNA, 22 bp, Homo sapiens
taaatgcttagattcatagaaa

SEQ ID NO: 10043975 - DNA, 22 bp, Homo sapiens
taaaaaacattactctgtcctg

SEQ ID NO: 10043976 - DNA, 22 bp, Homo sapiens
taaaaatcttatgaatggcaag

SEQ ID NO: 10043977 - DNA, 22 bp, Homo sapiens
taaaatcattctggtgtcagta

SEQ ID NO: 10043978 - DNA, 22 bp, Homo sapiens
taaaatcaccaaaagcaggtgg

SEQ ID NO: 10043979 - DNA, 22 bp, Homo sapiens
taaaccttcatgatggtcatta

SEQ ID NO: 10043980 - DNA, 18 bp, Homo sapiens
taaacctttcttgtggca

SEQ ID NO: 10043981 - DNA, 22 bp, Homo sapiens
caggacccatcagccaggcact

SEQ ID NO: 10043982 - DNA, 22 bp, Homo sapiens
caggacccaacctccctgctct

SEQ ID NO: 10043983 - DNA, 22 bp, Homo sapiens
caggaagtgcctggtgagagga

SEQ ID NO: 10043984 - DNA, 22 bp, Homo sapiens
catgatctggtcctactgtggg

SEQ ID NO: 10043985 - DNA, 22 bp, Homo sapiens
catgataattgttaacaaagta

SEQ ID NO: 10043986 - DNA, 22 bp, Homo sapiens
catatcttatggttttctaagt

SEQ ID NO: 10043987 - DNA, 22 bp, Homo sapiens
catatcttctgacatgatcagg

SEQ ID NO: 10043988 - DNA, 22 bp, Homo sapiens
catatacacttccacctctgtg

SEQ ID NO: 10043989 - DNA, 20 bp, Homo sapiens
catatatacctagaagtgga

SEQ ID NO: 10043990 - DNA, 22 bp, Homo sapiens
tcaggaagtggtaaaggatgtt

SEQ ID NO: 10043991 - DNA, 22 bp, Homo sapiens
catcacagtttgtcagaaatca

SEQ ID NO: 10043992 - DNA, 22 bp, Homo sapiens
catcacagtttgtcagaaatca

SEQ ID NO: 10043993 - DNA, 22 bp, Homo sapiens
tcagggccacaacaccagagtc

SEQ ID NO: 10043994 - DNA, 19 bp, Homo sapiens
tcagggccatgagcgccac

SEQ ID NO: 10043995 - DNA, 22 bp, Homo sapiens
tcagggcccagagctcaggcaa

SEQ ID NO: 10043996 - DNA, 17 bp, Homo sapiens
cagtttcttccccctct

SEQ ID NO: 10043997 - DNA, 22 bp, Homo sapiens
catagaaaagagtaggtaatgt

SEQ ID NO: 10043998 - DNA, 22 bp, Homo sapiens
tcagctgcataacaaagtatga

SEQ ID NO: 10043999 - DNA, 22 bp, Homo sapiens
cagtgcaacttttgcctcccgg

SEQ ID NO: 10044000 - DNA, 22 bp, Homo sapiens
cagtctcaccctggaggcccca

SEQ ID NO: 10044001 - DNA, 22 bp, Homo sapiens
tatggagattcaaaagcatctt

SEQ ID NO: 10044002 - DNA, 22 bp, Homo sapiens
tatctctttattgacaataaaa

SEQ ID NO: 10044003 - DNA, 22 bp, Homo sapiens
tatgtgcattattaccagtgga

SEQ ID NO: 10044004 - DNA, 22 bp, Homo sapiens
tattgcttttatttctatggac

SEQ ID NO: 10044005 - DNA, 22 bp, Homo sapiens
cagggtggcacatcacagcatt

SEQ ID NO: 10044006 - DNA, 22 bp, Homo sapiens
cagggtggaagctgtagagtgg

SEQ ID NO: 10044007 - DNA, 22 bp, Homo sapiens
cagggtggaatggaatgctggc

SEQ ID NO: 10044008 - DNA, 22 bp, Homo sapiens
tatacagtcttttgctatattc

SEQ ID NO: 10044009 - DNA, 22 bp, Homo sapiens
tataagaagtgaagaagagtta

SEQ ID NO: 10044010 - DNA, 22 bp, Homo sapiens
tataagaaattgccaacctgtt

SEQ ID NO: 10044011 - DNA, 22 bp, Homo sapiens
cagggtggaacaggcaatactt

SEQ ID NO: 10044012 - DNA, 22 bp, Homo sapiens
cagggtggaaaagctagttgga

SEQ ID NO: 10044013 - DNA, 22 bp, Homo sapiens
tctcttggtgatagtctttctt

SEQ ID NO: 10044014 - DNA, 22 bp, Homo sapiens
tctcttaactggttcagcaatt

SEQ ID NO: 10044015 - DNA, 22 bp, Homo sapiens
tctcttggaggttcttcctgtt

SEQ ID NO: 10044016 - DNA, 22 bp, Homo sapiens
tctcttggacatgtggctctgc

SEQ ID NO: 10044017 - DNA, 22 bp, Homo sapiens
tctcttggaaagcttgcccact

SEQ ID NO: 10044018 - DNA, 22 bp, Homo sapiens
tctgtcttcatcagcatgtgat

SEQ ID NO: 10044019 - DNA, 22 bp, Homo sapiens
ccaaagtgctgggattacaggt

SEQ ID NO: 10044020 - DNA, 22 bp, Homo sapiens
tcccagggcttttctcatgctt

SEQ ID NO: 10044021 - DNA, 21 bp, Homo sapiens
tcccagggccaggtgccatca

SEQ ID NO: 10044022 - DNA, 22 bp, Homo sapiens
ccaaagtgctgggattacaggc

SEQ ID NO: 10044023 - DNA, 22 bp, Homo sapiens
ccaaagtgctgagattacaggt

SEQ ID NO: 10044024 - DNA, 22 bp, Homo sapiens
ccaaagtgctaggattacaggt

SEQ ID NO: 10044025 - DNA, 22 bp, Homo sapiens
ccaaagtgctaggattacaggc

SEQ ID NO: 10044026 - DNA, 22 bp, Homo sapiens
ccacagggtcagccactctgca

SEQ ID NO: 10044027 - DNA, 22 bp, Homo sapiens
ccactctgctgtgctccatgat

SEQ ID NO: 10044028 - DNA, 22 bp, Homo sapiens
ccactctgatttcaagggagat

SEQ ID NO: 10044029 - DNA, 22 bp, Homo sapiens
ccactgcacttcagcctgggtg

SEQ ID NO: 10044030 - DNA, 22 bp, Homo sapiens
ccagaaaagcatctggttcttt

SEQ ID NO: 10044031 - DNA, 22 bp, Homo sapiens
ccagaatgttctagagccaccc

SEQ ID NO: 10044032 - DNA, 22 bp, Homo sapiens
tctttccagaggaatttttaga

SEQ ID NO: 10044033 - DNA, 22 bp, Homo sapiens
tctttcctgtaactgctgttca

SEQ ID NO: 10044034 - DNA, 23 bp, Homo sapiens
tctttcctcagcacacaccaaga

SEQ ID NO: 10044035 - DNA, 22 bp, Homo sapiens
tctttcctaggtgatatgcaat

SEQ ID NO: 10044036 - DNA, 22 bp, Homo sapiens
tcttggactcaaaattgcctta

SEQ ID NO: 10044037 - DNA, 22 bp, Homo sapiens
tcttggccaggtgtggtgcctc

SEQ ID NO: 10044038 - DNA, 22 bp, Homo sapiens
tcttgctagaatcatttggaga

SEQ ID NO: 10044039 - DNA, 22 bp, Homo sapiens
tcttgctaaagaccaacacatt

SEQ ID NO: 10044040 - DNA, 22 bp, Homo sapiens
tcttgctaggagctatggaaga

SEQ ID NO: 10044041 - DNA, 22 bp, Homo sapiens
tcttctccataatcaacactct

SEQ ID NO: 10044042 - DNA, 22 bp, Homo sapiens
tcttccttctttgatgacaagg

SEQ ID NO: 10044043 - DNA, 22 bp, Homo sapiens
tcttcaaaaatacaggttttca

SEQ ID NO: 10044044 - DNA, 22 bp, Homo sapiens
tcttcaaaccctggttttgtga

SEQ ID NO: 10044045 - DNA, 22 bp, Homo sapiens
tcttcaaatacagtcatattga

SEQ ID NO: 10044046 - DNA, 22 bp, Homo sapiens
tctgttttgtaccagatacagc

SEQ ID NO: 10044047 - DNA, 22 bp, Homo sapiens
tcttaagaaagtgacaaatagg

SEQ ID NO: 10044048 - DNA, 22 bp, Homo sapiens
tctgtttaatgggaatgatact

SEQ ID NO: 10044049 - DNA, 22 bp, Homo sapiens
tctgtctgcacctaagcacagt

SEQ ID NO: 10044050 - DNA, 20 bp, Homo sapiens
tctgcactcctgcatgtgcc

SEQ ID NO: 10044051 - DNA, 18 bp, Homo sapiens
tctgcactcctgagagag

SEQ ID NO: 10044052 - DNA, 22 bp, Homo sapiens
tctgcagaaactgtgactatgt

SEQ ID NO: 10044053 - DNA, 22 bp, Homo sapiens
tctgcaccctgtggtcctctag

SEQ ID NO: 10044054 - DNA, 22 bp, Homo sapiens
tctgcacccttctgggttggaa

SEQ ID NO: 10044055 - DNA, 22 bp, Homo sapiens
tctgcaccccgcagggtcaggt

SEQ ID NO: 10044056 - DNA, 22 bp, Homo sapiens
tctgcagatttatcagcagctg

SEQ ID NO: 10044057 - DNA, 22 bp, Homo sapiens
tctgcagaactttatgagcaaa

SEQ ID NO: 10044058 - DNA, 22 bp, Homo sapiens
tctgcacataggtaggctggaa

SEQ ID NO: 10044059 - DNA, 22 bp, Homo sapiens
tctgcacaggagggccgtggtg

SEQ ID NO: 10044060 - DNA, 21 bp, Homo sapiens
tctgcacagccccgcaggagg

SEQ ID NO: 10044061 - DNA, 22 bp, Homo sapiens
tctgcacaccgccaggctgact

SEQ ID NO: 10044062 - DNA, 23 bp, Homo sapiens
tctgggccacttgtctgcacttc

SEQ ID NO: 10044063 - DNA, 21 bp, Homo sapiens
tctgggcccatgctgcctcac

SEQ ID NO: 10044064 - DNA, 22 bp, Homo sapiens
tctggagggggatgcctcatcc

SEQ ID NO: 10044065 - DNA, 22 bp, Homo sapiens
tctggcaaaggcaaccacagtt

SEQ ID NO: 10044066 - DNA, 22 bp, Homo sapiens
tctggatgaagacccagaggct

SEQ ID NO: 10044067 - DNA, 22 bp, Homo sapiens
tctggatgctctgagcccaagg

SEQ ID NO: 10044068 - DNA, 22 bp, Homo sapiens
tctggatgacagaatggtcata

SEQ ID NO: 10044069 - DNA, 22 bp, Homo sapiens
tctccccagctgagctgccctt

SEQ ID NO: 10044070 - DNA, 22 bp, Homo sapiens
tctcagcagccagatccagagc

SEQ ID NO: 10044071 - DNA, 22 bp, Homo sapiens
tctcatgtgattcccgtgcatg

SEQ ID NO: 10044072 - DNA, 20 bp, Homo sapiens
tctcttttagcttacagctg

SEQ ID NO: 10044073 - DNA, 22 bp, Homo sapiens
tctgaaagaaagattttgtttc

SEQ ID NO: 10044074 - DNA, 19 bp, Homo sapiens
tctgaagaattagagagca

SEQ ID NO: 10044075 - DNA, 22 bp, Homo sapiens
tctcttctgaaacctgtcttta

SEQ ID NO: 10044076 - DNA, 22 bp, Homo sapiens
tctcttcttgattttcactgga

SEQ ID NO: 10044077 - DNA, 22 bp, Homo sapiens
tctcttcttgtgttttcctgcc

SEQ ID NO: 10044078 - DNA, 22 bp, Homo sapiens
tctctcaggctggagtgcagtg

SEQ ID NO: 10044079 - DNA, 22 bp, Homo sapiens
tctctcagggggaaggctgaag

SEQ ID NO: 10044080 - DNA, 22 bp, Homo sapiens
tctctgaaggggagctgtttaa

SEQ ID NO: 10044081 - DNA, 22 bp, Homo sapiens
tctaaaaaagtctgttcacttg

SEQ ID NO: 10044082 - DNA, 22 bp, Homo sapiens
tcgcccagctcatctcccacaa

SEQ ID NO: 10044083 - DNA, 22 bp, Homo sapiens
tccttaggcaatttgggagagt

SEQ ID NO: 10044084 - DNA, 22 bp, Homo sapiens
tccttggaagagcattcccagg

SEQ ID NO: 10044085 - DNA, 22 bp, Homo sapiens
tctacaaagccattcaggatct

SEQ ID NO: 10044086 - DNA, 22 bp, Homo sapiens
tctacagggtcagagtttcatg

SEQ ID NO: 10044087 - DNA, 19 bp, Homo sapiens
tctacaaagtggcatcagg

SEQ ID NO: 10044088 - DNA, 22 bp, Homo sapiens
tctagcaggtggcggccagcga

SEQ ID NO: 10044089 - DNA, 22 bp, Homo sapiens
tctagcagagggaagaggcttt

SEQ ID NO: 10044090 - DNA, 22 bp, Homo sapiens
tctagcagggaaagcagagaat

SEQ ID NO: 10044091 - DNA, 22 bp, Homo sapiens
tcctgggaggcggaggttgcag

SEQ ID NO: 10044092 - DNA, 22 bp, Homo sapiens
tcctgtgccatctctagagact

SEQ ID NO: 10044093 - DNA, 20 bp, Homo sapiens
tcctgtggacattgctggcc

SEQ ID NO: 10044094 - DNA, 22 bp, Homo sapiens
tcctgtggcgttatcatgtgat

SEQ ID NO: 10044095 - DNA, 22 bp, Homo sapiens
tcctggccataggctatttcag

SEQ ID NO: 10044096 - DNA, 22 bp, Homo sapiens
tcctggccacccgacagaagtc

SEQ ID NO: 10044097 - DNA, 22 bp, Homo sapiens
tcctggccacacattaatagtg

SEQ ID NO: 10044098 - DNA, 22 bp, Homo sapiens
tcctggccaagttactctctgc

SEQ ID NO: 10044099 - DNA, 22 bp, Homo sapiens
tcctggatttaaccctggctct

SEQ ID NO: 10044100 - DNA, 22 bp, Homo sapiens
tcctggattctgccctgaaggc

SEQ ID NO: 10044101 - DNA, 22 bp, Homo sapiens
tcctggatggagctgccctcgc

SEQ ID NO: 10044102 - DNA, 22 bp, Homo sapiens
tcctggatggcctgcaggcggt

SEQ ID NO: 10044103 - DNA, 22 bp, Homo sapiens
tcctggattaatagggagctgt

SEQ ID NO: 10044104 - DNA, 17 bp, Homo sapiens
tcctggatccatggtgg

SEQ ID NO: 10044105 - DNA, 22 bp, Homo sapiens
tcctggatcagcgggggcaggc

SEQ ID NO: 10044106 - DNA, 22 bp, Homo sapiens
tcctggccctctgcaaacgcca

SEQ ID NO: 10044107 - DNA, 22 bp, Homo sapiens
tcctgcttaacatatggtcaag

SEQ ID NO: 10044108 - DNA, 22 bp, Homo sapiens
taagaattatctcatggataat

SEQ ID NO: 10044109 - DNA, 20 bp, Homo sapiens
tgagaagctcctgtctcctc

SEQ ID NO: 10044110 - DNA, 22 bp, Homo sapiens
tgagaaatgggtctgctgaaga

SEQ ID NO: 10044111 - DNA, 22 bp, Homo sapiens
tgagaaaattactataattgtc

SEQ ID NO: 10044112 - DNA, 22 bp, Homo sapiens
tgagatggcaacaccagctttg

SEQ ID NO: 10044113 - DNA, 22 bp, Homo sapiens
tgagatgggtcatcaggtttgg

SEQ ID NO: 10044114 - DNA, 22 bp, Homo sapiens
tgagatggggtcatgctttgtc

SEQ ID NO: 10044115 - DNA, 22 bp, Homo sapiens
tgagatgggtgtccagggagga

SEQ ID NO: 10044116 - DNA, 22 bp, Homo sapiens
tgagatggttcacagagaaggc

SEQ ID NO: 10044117 - DNA, 22 bp, Homo sapiens
tgagataatacttcttagctgg

SEQ ID NO: 10044118 - DNA, 22 bp, Homo sapiens
tgagataatcatgtgatttcat

SEQ ID NO: 10044119 - DNA, 22 bp, Homo sapiens
tgagatggagttctgctcttgt

SEQ ID NO: 10044120 - DNA, 22 bp, Homo sapiens
tgagatggaaggtgaggcagta

SEQ ID NO: 10044121 - DNA, 22 bp, Homo sapiens
tgagagggcccagagcacacca

SEQ ID NO: 10044122 - DNA, 22 bp, Homo sapiens
tgagcagggactttgagtgtag

SEQ ID NO: 10044123 - DNA, 22 bp, Homo sapiens
tgagcaggcaaacaatggttat

SEQ ID NO: 10044124 - DNA, 22 bp, Homo sapiens
tgagcaggcgcagcaggaggtc

SEQ ID NO: 10044125 - DNA, 22 bp, Homo sapiens
tgagcaggactcactgcagcct

SEQ ID NO: 10044126 - DNA, 22 bp, Homo sapiens
tgagcagagcagtaacaggagc

SEQ ID NO: 10044127 - DNA, 22 bp, Homo sapiens
tgagcagggactttggagtctg

SEQ ID NO: 10044128 - DNA, 22 bp, Homo sapiens
tgagcagggactttggagtctg

SEQ ID NO: 10044129 - DNA, 22 bp, Homo sapiens
tgagcagggagctgggctgagc

SEQ ID NO: 10044130 - DNA, 22 bp, Homo sapiens
tgagcttttaatatacaggtgt

SEQ ID NO: 10044131 - DNA, 22 bp, Homo sapiens
tgagcccatgtagcacttccat

SEQ ID NO: 10044132 - DNA, 22 bp, Homo sapiens
tgaggtagaaaaagcttgtagt

SEQ ID NO: 10044133 - DNA, 22 bp, Homo sapiens
tgaggtagagattgtgactgta

SEQ ID NO: 10044134 - DNA, 22 bp, Homo sapiens
tgaggtaggaatttgtattggg

SEQ ID NO: 10044135 - DNA, 22 bp, Homo sapiens
tgaggtagctgctatttgtagt

SEQ ID NO: 10044136 - DNA, 22 bp, Homo sapiens
tgaggtaggagggtgatcagca

SEQ ID NO: 10044137 - DNA, 22 bp, Homo sapiens
tgagggagttgggtgtatagga

SEQ ID NO: 10044138 - DNA, 22 bp, Homo sapiens
tgagggagtgtggatacagtag

SEQ ID NO: 10044139 - DNA, 22 bp, Homo sapiens
tgagggagagggcgaaaatgaa

SEQ ID NO: 10044140 - DNA, 22 bp, Homo sapiens
tgagggagcacacactgaagtg

SEQ ID NO: 10044141 - DNA, 22 bp, Homo sapiens
tgagggagctgacctttctgtg

SEQ ID NO: 10044142 - DNA, 22 bp, Homo sapiens
tgagggaggccctttgagcaga

SEQ ID NO: 10044143 - DNA, 22 bp, Homo sapiens
tgagggaggcctccatctgcca

SEQ ID NO: 10044144 - DNA, 20 bp, Homo sapiens
tgagggagtattgatttccc

SEQ ID NO: 10044145 - DNA, 22 bp, Homo sapiens
tgagggagtcatgattaaggaa

SEQ ID NO: 10044146 - DNA, 16 bp, Homo sapiens
tgacagaaagatctat

SEQ ID NO: 10044147 - DNA, 22 bp, Homo sapiens
tgacagtgacagccaaaggctt

SEQ ID NO: 10044148 - DNA, 22 bp, Homo sapiens
tgacaggatgatgagcaggggg

SEQ ID NO: 10044149 - DNA, 22 bp, Homo sapiens
tgacaggagggttgtggcaggg

SEQ ID NO: 10044150 - DNA, 22 bp, Homo sapiens
tgacagcataacactggtcttg

SEQ ID NO: 10044151 - DNA, 22 bp, Homo sapiens
tgacaggaaacatgcagtgatt

SEQ ID NO: 10044152 - DNA, 22 bp, Homo sapiens
tgacaggaggcttgaggccagg

SEQ ID NO: 10044153 - DNA, 22 bp, Homo sapiens
tgaagtttaaggttagataagt

SEQ ID NO: 10044154 - DNA, 22 bp, Homo sapiens
tgaagtttaattttggacatga

SEQ ID NO: 10044155 - DNA, 22 bp, Homo sapiens
tgaagtttataacatagcctcc

SEQ ID NO: 10044156 - DNA, 22 bp, Homo sapiens
tgaagtttcacgcgtcattcaa

SEQ ID NO: 10044157 - DNA, 22 bp, Homo sapiens
tgaagtttcctctgaggccagt

SEQ ID NO: 10044158 - DNA, 22 bp, Homo sapiens
tgaagtttcttgaatcttggag

SEQ ID NO: 10044159 - DNA, 22 bp, Homo sapiens
tgaagtttgaactgtgttgctg

SEQ ID NO: 10044160 - DNA, 22 bp, Homo sapiens
tgaagttttactaggtgaattt

SEQ ID NO: 10044161 - DNA, 22 bp, Homo sapiens
tgaagttttacatcctctccaa

SEQ ID NO: 10044162 - DNA, 22 bp, Homo sapiens
tgaagtttggtggaaatttcct

SEQ ID NO: 10044163 - DNA, 22 bp, Homo sapiens
tgaagttttctggttgattaag

SEQ ID NO: 10044164 - DNA, 22 bp, Homo sapiens
tgaagtttttccagacaagtcc

SEQ ID NO: 10044165 - DNA, 22 bp, Homo sapiens
tgaaaagtcttatattgtctga

SEQ ID NO: 10044166 - DNA, 22 bp, Homo sapiens
tcttttgttgcctacttattaa

SEQ ID NO: 10044167 - DNA, 22 bp, Homo sapiens
tctttgtgttcaggagccacgt

SEQ ID NO: 10044168 - DNA, 20 bp, Homo sapiens
tctttgtgtcagatggacag

SEQ ID NO: 10044169 - DNA, 22 bp, Homo sapiens
tctttggaagctttcagagaag

SEQ ID NO: 10044170 - DNA, 22 bp, Homo sapiens
tctttggcatcagggccagcta

SEQ ID NO: 10044171 - DNA, 22 bp, Homo sapiens
tctttggaatgctagcattcta

SEQ ID NO: 10044172 - DNA, 22 bp, Homo sapiens
tctttggatcccaactggctgg

SEQ ID NO: 10044173 - DNA, 22 bp, Homo sapiens
tctttggatctcaaggtggcag

SEQ ID NO: 10044174 - DNA, 22 bp, Homo sapiens
tgccatgtttaaagttgaaggg

SEQ ID NO: 10044175 - DNA, 22 bp, Homo sapiens
tgcccagcagggagctacctgg

SEQ ID NO: 10044176 - DNA, 22 bp, Homo sapiens
tgcccagcactgtgccagtcac

SEQ ID NO: 10044177 - DNA, 22 bp, Homo sapiens
tgcccagcacccagcatgatgc

SEQ ID NO: 10044178 - DNA, 22 bp, Homo sapiens
tgcccagcaataaaccagaaga

SEQ ID NO: 10044179 - DNA, 20 bp, Homo sapiens
tgcccagcaagagtgcagtt

SEQ ID NO: 10044180 - DNA, 20 bp, Homo sapiens
tgccccaggcctgcacctgc

SEQ ID NO: 10044181 - DNA, 22 bp, Homo sapiens
tgccctggaaatgagaggtgtg

SEQ ID NO: 10044182 - DNA, 22 bp, Homo sapiens
tgcccctgacctcaggcgaagg

SEQ ID NO: 10044183 - DNA, 17 bp, Homo sapiens
tgcctgccagcattgga

SEQ ID NO: 10044184 - DNA, 22 bp, Homo sapiens
tgcctccctggcaagtctctcc

SEQ ID NO: 10044185 - DNA, 22 bp, Homo sapiens
tgcctctgtggaaatggtggtc

SEQ ID NO: 10044186 - DNA, 22 bp, Homo sapiens
tgcctcttggagcctttcctct

SEQ ID NO: 10044187 - DNA, 22 bp, Homo sapiens
tgcaggtgtgggcaggggagca

SEQ ID NO: 10044188 - DNA, 22 bp, Homo sapiens
tgcataaaatatgagaaatgta

SEQ ID NO: 10044189 - DNA, 22 bp, Homo sapiens
tgcataaacagatacttcatgt

SEQ ID NO: 10044190 - DNA, 21 bp, Homo sapiens
tgcataaagaaatacaaatac

SEQ ID NO: 10044191 - DNA, 19 bp, Homo sapiens
tgcataaattatatacttt

SEQ ID NO: 10044192 - DNA, 22 bp, Homo sapiens
tgcataaaacaccagcagggtg

SEQ ID NO: 10044193 - DNA, 22 bp, Homo sapiens
tgcataaaaaccacatacaagg

SEQ ID NO: 10044194 - DNA, 19 bp, Homo sapiens
tgcataaattatatacttt

SEQ ID NO: 10044195 - DNA, 21 bp, Homo sapiens
tgcatgctcataggaaaatag

SEQ ID NO: 10044196 - DNA, 22 bp, Homo sapiens
tgcatgctctgtagaaagcagg

SEQ ID NO: 10044197 - DNA, 22 bp, Homo sapiens
tgccaccaggagaaccagtgca

SEQ ID NO: 10044198 - DNA, 23 bp, Homo sapiens
tgccaaagtttacctaacactgg

SEQ ID NO: 10044199 - DNA, 22 bp, Homo sapiens
tgcaaaagaatatagatattgt

SEQ ID NO: 10044200 - DNA, 22 bp, Homo sapiens
tgcaaagaaaacactgcaagac

SEQ ID NO: 10044201 - DNA, 22 bp, Homo sapiens
tgcacaagtcagagtaacattt

SEQ ID NO: 10044202 - DNA, 19 bp, Homo sapiens
tgcacacagataagtatct

SEQ ID NO: 10044203 - DNA, 22 bp, Homo sapiens
tgcacacagctgggcctggctg

SEQ ID NO: 10044204 - DNA, 22 bp, Homo sapiens
tgcacacacggagataggcttt

SEQ ID NO: 10044205 - DNA, 22 bp, Homo sapiens
tgcacacacatgcagagggaga

SEQ ID NO: 10044206 - DNA, 22 bp, Homo sapiens
tgcacacacatgaagtagcatg

SEQ ID NO: 10044207 - DNA, 22 bp, Homo sapiens
tgcacacacacgtagagaaaag

SEQ ID NO: 10044208 - DNA, 22 bp, Homo sapiens
tgcaagtaaccatcactatctc

SEQ ID NO: 10044209 - DNA, 22 bp, Homo sapiens
tgcaagcaatccaggaaggcta

SEQ ID NO: 10044210 - DNA, 22 bp, Homo sapiens
tgatagaagcagaagcatacca

SEQ ID NO: 10044211 - DNA, 22 bp, Homo sapiens
tgatagaaaggaaattaattgg

SEQ ID NO: 10044212 - DNA, 22 bp, Homo sapiens
tgatcagcatcttcccagctcg

SEQ ID NO: 10044213 - DNA, 22 bp, Homo sapiens
tgatggagcatgtgtgcttcct

SEQ ID NO: 10044214 - DNA, 22 bp, Homo sapiens
tgatggaggacccagcgtggga

SEQ ID NO: 10044215 - DNA, 18 bp, Homo sapiens
tgatggaggagggctggt

SEQ ID NO: 10044216 - DNA, 22 bp, Homo sapiens
tgcagaagctgcaggtcagtgg

SEQ ID NO: 10044217 - DNA, 22 bp, Homo sapiens
tgcagaaggaggaggaaatcca

SEQ ID NO: 10044218 - DNA, 22 bp, Homo sapiens
tgcagaaggcctgacattgcac

SEQ ID NO: 10044219 - DNA, 22 bp, Homo sapiens
tgcagaagtattccaggcccca

SEQ ID NO: 10044220 - DNA, 22 bp, Homo sapiens
tgcagaagtgagtcatgaggaa

SEQ ID NO: 10044221 - DNA, 22 bp, Homo sapiens
tgcagaagatggtctgagcacc

SEQ ID NO: 10044222 - DNA, 22 bp, Homo sapiens
tgcagaagatggtctgagcacc

SEQ ID NO: 10044223 - DNA, 22 bp, Homo sapiens
tgcagaagaccttccagggctg

SEQ ID NO: 10044224 - DNA, 22 bp, Homo sapiens
tgcagaagcagagccggtggcc

SEQ ID NO: 10044225 - DNA, 22 bp, Homo sapiens
tgcagaagcagagagttgccaa

SEQ ID NO: 10044226 - DNA, 19 bp, Homo sapiens
tgcagaagacacagtggtg

SEQ ID NO: 10044227 - DNA, 22 bp, Homo sapiens
tgcagaagacacaaggtaacgt

SEQ ID NO: 10044228 - DNA, 22 bp, Homo sapiens
tgcagaagaatgtaggcataag

SEQ ID NO: 10044229 - DNA, 22 bp, Homo sapiens
tgcagaagaatgtaggcataag

SEQ ID NO: 10044230 - DNA, 20 bp, Homo sapiens
tgcagaagaacgttctggtt

SEQ ID NO: 10044231 - DNA, 22 bp, Homo sapiens
tgcagaaacaagccatcattca

SEQ ID NO: 10044232 - DNA, 22 bp, Homo sapiens
tgcagaaacaagccatcattca

SEQ ID NO: 10044233 - DNA, 22 bp, Homo sapiens
tgcagaaataactcatattgca

SEQ ID NO: 10044234 - DNA, 22 bp, Homo sapiens
tgcagaaataactcatattgca

SEQ ID NO: 10044235 - DNA, 22 bp, Homo sapiens
tgcacccatagcacacactcct

SEQ ID NO: 10044236 - DNA, 22 bp, Homo sapiens
tgcaccctcatcagtcaaatgg

SEQ ID NO: 10044237 - DNA, 22 bp, Homo sapiens
tgcaccacccgtgggaggactg

SEQ ID NO: 10044238 - DNA, 22 bp, Homo sapiens
tgcacaggtgagactcaggaag

SEQ ID NO: 10044239 - DNA, 22 bp, Homo sapiens
tgcacatggcaatgctgctccc

SEQ ID NO: 10044240 - DNA, 22 bp, Homo sapiens
tgcacacagtggacaagtcttg

SEQ ID NO: 10044241 - DNA, 22 bp, Homo sapiens
tgcacagggagggggccagctc

SEQ ID NO: 10044242 - DNA, 20 bp, Homo sapiens
tgcacagggtgggaagcaac

SEQ ID NO: 10044243 - DNA, 22 bp, Homo sapiens
tgcagaggagctggaaggctgg

SEQ ID NO: 10044244 - DNA, 22 bp, Homo sapiens
tgcagcagaagtgttcttctct

SEQ ID NO: 10044245 - DNA, 21 bp, Homo sapiens
tgcagcagaagtctctgtgtc

SEQ ID NO: 10044246 - DNA, 20 bp, Homo sapiens
tgcagcagaagcccatgctc

SEQ ID NO: 10044247 - DNA, 23 bp, Homo sapiens
tgcagagggactgaagccagctt

SEQ ID NO: 10044248 - DNA, 22 bp, Homo sapiens
tgcagcctttagaagttcagat

SEQ ID NO: 10044249 - DNA, 22 bp, Homo sapiens
tgcagcagactgagtatgagaa

SEQ ID NO: 10044250 - DNA, 22 bp, Homo sapiens
tgcagcagacataatgtggatt

SEQ ID NO: 10044251 - DNA, 21 bp, Homo sapiens
tgcagcagagtaagcagggga

SEQ ID NO: 10044252 - DNA, 22 bp, Homo sapiens
tgcagcagggacctctatgtga

SEQ ID NO: 10044253 - DNA, 22 bp, Homo sapiens
tgcagcagggcccaggcacaga

SEQ ID NO: 10044254 - DNA, 22 bp, Homo sapiens
tgcagcagccaaggttctgtgc

SEQ ID NO: 10044255 - DNA, 22 bp, Homo sapiens
tgcagcagcagggaggaggctc

SEQ ID NO: 10044256 - DNA, 22 bp, Homo sapiens
tgcagcagcctcatctggtttc

SEQ ID NO: 10044257 - DNA, 22 bp, Homo sapiens
tgcagcctagacattctggtca

SEQ ID NO: 10044258 - DNA, 22 bp, Homo sapiens
tgcagcctctctgcttcaggaa

SEQ ID NO: 10044259 - DNA, 22 bp, Homo sapiens
tgcagcctggtggtcactggag

SEQ ID NO: 10044260 - DNA, 18 bp, Homo sapiens
tgcagcctgtagtcttgt

SEQ ID NO: 10044261 - DNA, 23 bp, Homo sapiens
tgcagcagggtggtctacttctc

SEQ ID NO: 10044262 - DNA, 22 bp, Homo sapiens
tgcaggagacataatagggact

SEQ ID NO: 10044263 - DNA, 22 bp, Homo sapiens
tgcaggagagtgagtcagtagg

SEQ ID NO: 10044264 - DNA, 22 bp, Homo sapiens
tgcaggaggattttgtggagct

SEQ ID NO: 10044265 - DNA, 22 bp, Homo sapiens
tgcaggaggccccatggaaccg

SEQ ID NO: 10044266 - DNA, 22 bp, Homo sapiens
tgcaggagggagggttacagtt

SEQ ID NO: 10044267 - DNA, 22 bp, Homo sapiens
tgcaggagtccaatcaggagac

SEQ ID NO: 10044268 - DNA, 22 bp, Homo sapiens
tgcaggagctgtgcggtgaggg

SEQ ID NO: 10044269 - DNA, 19 bp, Homo sapiens
tgcaggaggactgagcaga

SEQ ID NO: 10044270 - DNA, 22 bp, Homo sapiens
tgtggctgactcctggtcccca

SEQ ID NO: 10044271 - DNA, 22 bp, Homo sapiens
tgtggcgagaacattggaccat

SEQ ID NO: 10044272 - DNA, 22 bp, Homo sapiens
tgtgggagaaggaagcaagctg

SEQ ID NO: 10044273 - DNA, 20 bp, Homo sapiens
tgtgggcccttggctggcaa

SEQ ID NO: 10044274 - DNA, 22 bp, Homo sapiens
tgtgggccctaggcaccttgtc

SEQ ID NO: 10044275 - DNA, 22 bp, Homo sapiens
ttaaaatttccccaccatgtat

SEQ ID NO: 10044276 - DNA, 22 bp, Homo sapiens
tgttctttgccagtgatttaat

SEQ ID NO: 10044277 - DNA, 22 bp, Homo sapiens
tgtttatagggtctgtcacttg

SEQ ID NO: 10044278 - DNA, 22 bp, Homo sapiens
tgtcttttgccaaagatcagtt

SEQ ID NO: 10044279 - DNA, 17 bp, Homo sapiens
tgtcttctgaagagagc

SEQ ID NO: 10044280 - DNA, 22 bp, Homo sapiens
tgtcttctaccttgacagcatt

SEQ ID NO: 10044281 - DNA, 22 bp, Homo sapiens
tgtcttaagtagattacagcct

SEQ ID NO: 10044282 - DNA, 22 bp, Homo sapiens
tgtctgctagctggtggcaatt

SEQ ID NO: 10044283 - DNA, 22 bp, Homo sapiens
tgtctgccaaagcttcctcctg

SEQ ID NO: 10044284 - DNA, 22 bp, Homo sapiens
tgtgcagatagtgatttcagaa

SEQ ID NO: 10044285 - DNA, 22 bp, Homo sapiens
tgtgaatggacaattaaatcta

SEQ ID NO: 10044286 - DNA, 22 bp, Homo sapiens
tgtgaagtccagagaagtcagg

SEQ ID NO: 10044287 - DNA, 22 bp, Homo sapiens
tgtgacctcatcttaactggaa

SEQ ID NO: 10044288 - DNA, 22 bp, Homo sapiens
tgtgcaaaataataaatcactg

SEQ ID NO: 10044289 - DNA, 22 bp, Homo sapiens
tgtgcaaaataataaatcactg

SEQ ID NO: 10044290 - DNA, 22 bp, Homo sapiens
ttacaattgagtctattgtatg

SEQ ID NO: 10044291 - DNA, 22 bp, Homo sapiens
ttacattcaaggaactcattct

SEQ ID NO: 10044292 - DNA, 22 bp, Homo sapiens
ttacattcagaaagatttgagt

SEQ ID NO: 10044293 - DNA, 22 bp, Homo sapiens
ttacattcaatttctagaggta

SEQ ID NO: 10044294 - DNA, 22 bp, Homo sapiens
ttacattcttggaatcttgttt

SEQ ID NO: 10044295 - DNA, 22 bp, Homo sapiens
ttacattcttatctcagttatt

SEQ ID NO: 10044296 - DNA, 21 bp, Homo sapiens
ttacattcagaggagtggaag

SEQ ID NO: 10044297 - DNA, 22 bp, Homo sapiens
ttacattcattgaagtgattca

SEQ ID NO: 10044298 - DNA, 22 bp, Homo sapiens
ttacattcccagtgtgcagcat

SEQ ID NO: 10044299 - DNA, 21 bp, Homo sapiens
ttacaacatttgtgttctatg

SEQ ID NO: 10044300 - DNA, 22 bp, Homo sapiens
ttacaacaaaggcacgtgcatg

SEQ ID NO: 10044301 - DNA, 22 bp, Homo sapiens
ttacaaagtgttatgataaaca

SEQ ID NO: 10044302 - DNA, 19 bp, Homo sapiens
tgggcaggttcagtaatgg

SEQ ID NO: 10044303 - DNA, 22 bp, Homo sapiens
tgggccagctgaagtgccgccc

SEQ ID NO: 10044304 - DNA, 22 bp, Homo sapiens
tgggccagctccctgcccctgg

SEQ ID NO: 10044305 - DNA, 22 bp, Homo sapiens
tgggccagcaattgctgctcag

SEQ ID NO: 10044306 - DNA, 22 bp, Homo sapiens
tgggcagggagctggaaccaca

SEQ ID NO: 10044307 - DNA, 23 bp, Homo sapiens
tgggcagcttctgcatgcccacc

SEQ ID NO: 10044308 - DNA, 20 bp, Homo sapiens
tgggcctctggtgcctctgg

SEQ ID NO: 10044309 - DNA, 22 bp, Homo sapiens
tgggcctcctttccattcagag

SEQ ID NO: 10044310 - DNA, 19 bp, Homo sapiens
tgggcctctcatatctgcc

SEQ ID NO: 10044311 - DNA, 22 bp, Homo sapiens
tgggcctcaccttcttggcagc

SEQ ID NO: 10044312 - DNA, 21 bp, Homo sapiens
tgggcctcaggcagctgtgac

SEQ ID NO: 10044313 - DNA, 22 bp, Homo sapiens
tgggcctcagtttgcttaatgt

SEQ ID NO: 10044314 - DNA, 22 bp, Homo sapiens
tgggcctcatgcccagccaccc

SEQ ID NO: 10044315 - DNA, 22 bp, Homo sapiens
tgggcctcatcttcaatgagtc

SEQ ID NO: 10044316 - DNA, 22 bp, Homo sapiens
tgggcctcctgccctggcctag

SEQ ID NO: 10044317 - DNA, 22 bp, Homo sapiens
tgggccagggcacccagtccag

SEQ ID NO: 10044318 - DNA, 21 bp, Homo sapiens
tgggccagtagaaaggaaggc

SEQ ID NO: 10044319 - DNA, 22 bp, Homo sapiens
tgggccagtccagccccaggga

SEQ ID NO: 10044320 - DNA, 22 bp, Homo sapiens
tggtaagaataggggctttgga

SEQ ID NO: 10044321 - DNA, 22 bp, Homo sapiens
tggtaagataagagccaggcct

SEQ ID NO: 10044322 - DNA, 22 bp, Homo sapiens
tgggggcagaggattcaggaat

SEQ ID NO: 10044323 - DNA, 22 bp, Homo sapiens
tgggggcagccaggctgtcaag

SEQ ID NO: 10044324 - DNA, 22 bp, Homo sapiens
tggggccagagctgcagggagc

SEQ ID NO: 10044325 - DNA, 22 bp, Homo sapiens
tggggaagacagcagacactgt

SEQ ID NO: 10044326 - DNA, 22 bp, Homo sapiens
tggggaagggcaccctggagac

SEQ ID NO: 10044327 - DNA, 22 bp, Homo sapiens
tgtcacaaaaatcagtaattgc

SEQ ID NO: 10044328 - DNA, 22 bp, Homo sapiens
tgtatttaagctttacctaaaa

SEQ ID NO: 10044329 - DNA, 22 bp, Homo sapiens
tgtccctggactccaggagcca

SEQ ID NO: 10044330 - DNA, 22 bp, Homo sapiens
tgtcccagggaaggcccagcac

SEQ ID NO: 10044331 - DNA, 22 bp, Homo sapiens
tggttttagagtatattcaggg

SEQ ID NO: 10044332 - DNA, 23 bp, Homo sapiens
tgtaaaagcatttgtcagcctgg

SEQ ID NO: 10044333 - DNA, 22 bp, Homo sapiens
tggttcctggttcacttggcag

SEQ ID NO: 10044334 - DNA, 18 bp, Homo sapiens
tggttccttgaaggggca

SEQ ID NO: 10044335 - DNA, 22 bp, Homo sapiens
tggtgagatgtatggagggttg

SEQ ID NO: 10044336 - DNA, 22 bp, Homo sapiens
tggtgagagctgaccgtgcgag

SEQ ID NO: 10044337 - DNA, 22 bp, Homo sapiens
tggtgagataactttcggcaag

SEQ ID NO: 10044338 - DNA, 22 bp, Homo sapiens
tggtgagaccttgttccttatg

SEQ ID NO: 10044339 - DNA, 20 bp, Homo sapiens
tggtgagagcacctgatggg

SEQ ID NO: 10044340 - DNA, 22 bp, Homo sapiens
tggtcagaaggaagggctccta

SEQ ID NO: 10044341 - DNA, 22 bp, Homo sapiens
tggtcagaactcagcgtgcttg

SEQ ID NO: 10044342 - DNA, 22 bp, Homo sapiens
tggtgccatcatagctcactgc

SEQ ID NO: 10044343 - DNA, 22 bp, Homo sapiens
tggtgccacttcttaggctggt

SEQ ID NO: 10044344 - DNA, 22 bp, Homo sapiens
tggtgccaccctccttcagctg

SEQ ID NO: 10044345 - DNA, 22 bp, Homo sapiens
tggtgccattagccctgctgtt

SEQ ID NO: 10044346 - DNA, 22 bp, Homo sapiens
tggagaaggccggccaggagtg

SEQ ID NO: 10044347 - DNA, 22 bp, Homo sapiens
tggagaaggacagcctgagaaa

SEQ ID NO: 10044348 - DNA, 22 bp, Homo sapiens
tggagagttctgtagatatcta

SEQ ID NO: 10044349 - DNA, 22 bp, Homo sapiens
tggagagtgtagacttcagagt

SEQ ID NO: 10044350 - DNA, 22 bp, Homo sapiens
tggagaggtttaaacaaaagtt

SEQ ID NO: 10044351 - DNA, 22 bp, Homo sapiens
tggagcaggtgctcagggtaat

SEQ ID NO: 10044352 - DNA, 22 bp, Homo sapiens
tggagcagctctagcgggcgcc

SEQ ID NO: 10044353 - DNA, 22 bp, Homo sapiens
tggagcagtggtcctggagatg

SEQ ID NO: 10044354 - DNA, 22 bp, Homo sapiens
tggagccagcccaggcccctct

SEQ ID NO: 10044355 - DNA, 18 bp, Homo sapiens
tggagccattgccaccat

SEQ ID NO: 10044356 - DNA, 22 bp, Homo sapiens
tggagccaggctggccctgcca

SEQ ID NO: 10044357 - DNA, 22 bp, Homo sapiens
tggagccagtgttgcccaacac

SEQ ID NO: 10044358 - DNA, 22 bp, Homo sapiens
tggaggagtagattttcagagg

SEQ ID NO: 10044359 - DNA, 22 bp, Homo sapiens
tggaggagtgtgattgtctgcc

SEQ ID NO: 10044360 - DNA, 22 bp, Homo sapiens
tggaggagtgtgattgtctgcc

SEQ ID NO: 10044361 - DNA, 22 bp, Homo sapiens
tggaggatgcctggggaggcct

SEQ ID NO: 10044362 - DNA, 22 bp, Homo sapiens
tggaggattaatctggaaagat

SEQ ID NO: 10044363 - DNA, 22 bp, Homo sapiens
tggaggattccacttacatgag

SEQ ID NO: 10044364 - DNA, 22 bp, Homo sapiens
tggaggagaccgcattttattt

SEQ ID NO: 10044365 - DNA, 19 bp, Homo sapiens
tggaggagaggaaaagtca

SEQ ID NO: 10044366 - DNA, 22 bp, Homo sapiens
tggaggagggctggtgtctgta

SEQ ID NO: 10044367 - DNA, 22 bp, Homo sapiens
tggaggaggatgcatttgttgt

SEQ ID NO: 10044368 - DNA, 22 bp, Homo sapiens
tggaggaggaacttcttatctc

SEQ ID NO: 10044369 - DNA, 22 bp, Homo sapiens
tggaggaggaacttcttatctc

SEQ ID NO: 10044370 - DNA, 22 bp, Homo sapiens
tggaggagaccattccactcag

SEQ ID NO: 10044371 - DNA, 22 bp, Homo sapiens
tggaggagaatttatggtcgaa

SEQ ID NO: 10044372 - DNA, 22 bp, Homo sapiens
tggagggaacaaaggagtccca

SEQ ID NO: 10044373 - DNA, 22 bp, Homo sapiens
tggagggaacccaggctgctct

SEQ ID NO: 10044374 - DNA, 22 bp, Homo sapiens
tggagggatacaaagatgaaaa

SEQ ID NO: 10044375 - DNA, 20 bp, Homo sapiens
tggagggattgttggcaaat

SEQ ID NO: 10044376 - DNA, 22 bp, Homo sapiens
tggaggtgtccaactcgtgggt

SEQ ID NO: 10044377 - DNA, 22 bp, Homo sapiens
tggagtcagaatgcgacaggcc

SEQ ID NO: 10044378 - DNA, 22 bp, Homo sapiens
tggataaaatctgtaaggctca

SEQ ID NO: 10044379 - DNA, 22 bp, Homo sapiens
tggagtgggcaatgtaggcaag

SEQ ID NO: 10044380 - DNA, 22 bp, Homo sapiens
tggaacgtcgtaatgttggtta

SEQ ID NO: 10044381 - DNA, 22 bp, Homo sapiens
tggaaatagatagtatcattca

SEQ ID NO: 10044382 - DNA, 22 bp, Homo sapiens
tggaaacaggagaatatcttct

SEQ ID NO: 10044383 - DNA, 22 bp, Homo sapiens
tggaaaacaaagctctcattat

SEQ ID NO: 10044384 - DNA, 22 bp, Homo sapiens
tgcttgctctgctccaccaaga

SEQ ID NO: 10044385 - DNA, 22 bp, Homo sapiens
tgcttgctgaaaggcatttaga

SEQ ID NO: 10044386 - DNA, 22 bp, Homo sapiens
tgcttgctctccggactctaat

SEQ ID NO: 10044387 - DNA, 22 bp, Homo sapiens
tgcttgctcgccgcctgctgac

SEQ ID NO: 10044388 - DNA, 22 bp, Homo sapiens
tgcttgctccggccggggttgc

SEQ ID NO: 10044389 - DNA, 22 bp, Homo sapiens
tgcttgctccctcacactgtcc

SEQ ID NO: 10044390 - DNA, 22 bp, Homo sapiens
tgcttgctatgcatcctgaact

SEQ ID NO: 10044391 - DNA, 22 bp, Homo sapiens
tgctttctgctctggaaacagg

SEQ ID NO: 10044392 - DNA, 22 bp, Homo sapiens
tggaaggagactgggaagtgtg

SEQ ID NO: 10044393 - DNA, 22 bp, Homo sapiens
tggaataaaatgtcagttctta

SEQ ID NO: 10044394 - DNA, 22 bp, Homo sapiens
tggaccctggactgccctggcc

SEQ ID NO: 10044395 - DNA, 23 bp, Homo sapiens
tggaccctgcacaccagctctac

SEQ ID NO: 10044396 - DNA, 22 bp, Homo sapiens
tggaccctgaagcaacagggag

SEQ ID NO: 10044397 - DNA, 22 bp, Homo sapiens
tggaccctacccggccctcggc

SEQ ID NO: 10044398 - DNA, 22 bp, Homo sapiens
tggacccaggcaggtctgtcct

SEQ ID NO: 10044399 - DNA, 22 bp, Homo sapiens
tggacccaccccagggcctgct

SEQ ID NO: 10044400 - DNA, 22 bp, Homo sapiens
tggaccagggtcccagagtatg

SEQ ID NO: 10044401 - DNA, 22 bp, Homo sapiens
tggaccagcagccccagtgcct

SEQ ID NO: 10044402 - DNA, 22 bp, Homo sapiens
tgcgcccagccaagtctggcac

SEQ ID NO: 10044403 - DNA, 22 bp, Homo sapiens
tgctaaataacttacatagtgg

SEQ ID NO: 10044404 - DNA, 22 bp, Homo sapiens
tgctaaataagtggaatagaca

SEQ ID NO: 10044405 - DNA, 21 bp, Homo sapiens
tgctcatgcaatgcatgtcca

SEQ ID NO: 10044406 - DNA, 22 bp, Homo sapiens
tgcctgggttcccaccccaaag

SEQ ID NO: 10044407 - DNA, 22 bp, Homo sapiens
tgcctggggattgctctgggcc

SEQ ID NO: 10044408 - DNA, 20 bp, Homo sapiens
tgctctgggggtggagagac

SEQ ID NO: 10044409 - DNA, 17 bp, Homo sapiens
tgctcctgggacaagga

SEQ ID NO: 10044410 - DNA, 22 bp, Homo sapiens
tgctctgggctcaatggcagct

SEQ ID NO: 10044411 - DNA, 22 bp, Homo sapiens
tgctggcttggaaggaaagcgc

SEQ ID NO: 10044412 - DNA, 22 bp, Homo sapiens
tgcttccctcacttcacctggc

SEQ ID NO: 10044413 - DNA, 19 bp, Homo sapiens
tgcttcagaaatagaaagc

SEQ ID NO: 10044414 - DNA, 22 bp, Homo sapiens
tgcttagctcataggaaacact

SEQ ID NO: 10044415 - DNA, 22 bp, Homo sapiens
tgcttaaacacatacatacata

SEQ ID NO: 10044416 - DNA, 22 bp, Homo sapiens
tgctggcttagatatcactgcc

SEQ ID NO: 10044417 - DNA, 22 bp, Homo sapiens
tgctggagtgagtggtttctta

SEQ ID NO: 10044418 - DNA, 22 bp, Homo sapiens
tgggagcagctttgcgagggag

SEQ ID NO: 10044419 - DNA, 22 bp, Homo sapiens
tgggagcaccctgaggagcttc

SEQ ID NO: 10044420 - DNA, 22 bp, Homo sapiens
tgggaggagccctctgggaagg

SEQ ID NO: 10044421 - DNA, 22 bp, Homo sapiens
tgggaggacttgtgggcttcat

SEQ ID NO: 10044422 - DNA, 22 bp, Homo sapiens
tggctccatcatccatgcaaga

SEQ ID NO: 10044423 - DNA, 22 bp, Homo sapiens
tggctccaggggacacgcagta

SEQ ID NO: 10044424 - DNA, 22 bp, Homo sapiens
tggctccagatttcctgctgca

SEQ ID NO: 10044425 - DNA, 20 bp, Homo sapiens
tggctccagcctcccctacc

SEQ ID NO: 10044426 - DNA, 23 bp, Homo sapiens
tggctccaggagaagccagaagc

SEQ ID NO: 10044427 - DNA, 22 bp, Homo sapiens
tggctcagttaggtcagaaaca

SEQ ID NO: 10044428 - DNA, 22 bp, Homo sapiens
tggctcaggcttgaaaatagat

SEQ ID NO: 10044429 - DNA, 22 bp, Homo sapiens
tggctcagccagccctaggaac

SEQ ID NO: 10044430 - DNA, 22 bp, Homo sapiens
tggctcagtggcagccgcagct

SEQ ID NO: 10044431 - DNA, 22 bp, Homo sapiens
tggctcagggtccccaaatggt

SEQ ID NO: 10044432 - DNA, 21 bp, Homo sapiens
tggcggggacttgtggctgcc

SEQ ID NO: 10044433 - DNA, 22 bp, Homo sapiens
tggctcagaaggctgccttcac

SEQ ID NO: 10044434 - DNA, 22 bp, Homo sapiens
tggctcagatgctcttccagtg

SEQ ID NO: 10044435 - DNA, 22 bp, Homo sapiens
tggcgcagtttctctgctgcct

SEQ ID NO: 10044436 - DNA, 22 bp, Homo sapiens
tggctgaggagggtcttctggt

SEQ ID NO: 10044437 - DNA, 22 bp, Homo sapiens
tggctgaggtctggggcttctg

SEQ ID NO: 10044438 - DNA, 22 bp, Homo sapiens
tggcaaaatgagcaattacttt

SEQ ID NO: 10044439 - DNA, 22 bp, Homo sapiens
tggcacagcccattcagagaag

SEQ ID NO: 10044440 - DNA, 22 bp, Homo sapiens
tggcacagagggacccagcagc

SEQ ID NO: 10044441 - DNA, 22 bp, Homo sapiens
tggcacagacagcacagcaatg

SEQ ID NO: 10044442 - DNA, 20 bp, Homo sapiens
tggcacagaacccttgccta

SEQ ID NO: 10044443 - DNA, 22 bp, Homo sapiens
tggcacagaaaaatgctccatt

SEQ ID NO: 10044444 - DNA, 21 bp, Homo sapiens
tggcaatggccaacagtcatc

SEQ ID NO: 10044445 - DNA, 22 bp, Homo sapiens
tggcactgaaaaaggagaggtt

SEQ ID NO: 10044446 - DNA, 22 bp, Homo sapiens
tggcactgaaaaaggagaggtt

SEQ ID NO: 10044447 - DNA, 22 bp, Homo sapiens
tggcaccaccagacaccaggag

SEQ ID NO: 10044448 - DNA, 22 bp, Homo sapiens
tggcagctacagacagaggtga

SEQ ID NO: 10044449 - DNA, 22 bp, Homo sapiens
tggcaggatctttgagagtgaa

SEQ ID NO: 10044450 - DNA, 22 bp, Homo sapiens
tggcaggaaaaagggccagagg

SEQ ID NO: 10044451 - DNA, 23 bp, Homo sapiens
tggcaggaaatgagaatgttcct

SEQ ID NO: 10044452 - DNA, 22 bp, Homo sapiens
tggcaggaagacgtggggcacc

SEQ ID NO: 10044453 - DNA, 20 bp, Homo sapiens
tggcaggaatagggccagag

SEQ ID NO: 10044454 - DNA, 22 bp, Homo sapiens
tggcaggaaggagactcagccc

SEQ ID NO: 10044455 - DNA, 20 bp, Homo sapiens
tggcaggagccactggaagc

SEQ ID NO: 10044456 - DNA, 22 bp, Homo sapiens
tggcaggagagcgtcagatcag

SEQ ID NO: 10044457 - DNA, 20 bp, Homo sapiens
tggcaggactggctccaccc

SEQ ID NO: 10044458 - DNA, 20 bp, Homo sapiens
tggcaggaggcagcagtgga

SEQ ID NO: 10044459 - DNA, 22 bp, Homo sapiens
tggcaggagcctgcggggaggt

SEQ ID NO: 10044460 - DNA, 22 bp, Homo sapiens
tggcaggaggatgaggcggcta

SEQ ID NO: 10044461 - DNA, 22 bp, Homo sapiens
tggcccagactctgctcttatc

SEQ ID NO: 10044462 - DNA, 22 bp, Homo sapiens
tggcccagccctgctctagggc

SEQ ID NO: 10044463 - DNA, 22 bp, Homo sapiens
tggcccaagtctgctagaagag

SEQ ID NO: 10044464 - DNA, 15 bp, Homo sapiens
tggcccacccgttga

SEQ ID NO: 10044465 - DNA, 22 bp, Homo sapiens
tggcccagccctgctctagggc

SEQ ID NO: 10044466 - DNA, 22 bp, Homo sapiens
tggcccagctgcagatggtgga

SEQ ID NO: 10044467 - DNA, 22 bp, Homo sapiens
tggcccagctcagggtgggcgg

SEQ ID NO: 10044468 - DNA, 22 bp, Homo sapiens
tggccagtttgctcaggcagtc

SEQ ID NO: 10044469 - DNA, 22 bp, Homo sapiens
tggcccaaagcagcccagcagg

SEQ ID NO: 10044470 - DNA, 22 bp, Homo sapiens
tggccatgggatagtgcagggg

SEQ ID NO: 10044471 - DNA, 22 bp, Homo sapiens
tggccatgaaggaggcagcaga

SEQ ID NO: 10044472 - DNA, 22 bp, Homo sapiens
tggccatgacatggaggctttg

SEQ ID NO: 10044473 - DNA, 22 bp, Homo sapiens
tggccagtgtgtgctgccggct

SEQ ID NO: 10044474 - DNA, 22 bp, Homo sapiens
tggcccaggccaaagccctgga

SEQ ID NO: 10044475 - DNA, 22 bp, Homo sapiens
tggcccaggcgaggtgggcaga

SEQ ID NO: 10044476 - DNA, 22 bp, Homo sapiens
tggcccagggagttcatggtgt

SEQ ID NO: 10044477 - DNA, 22 bp, Homo sapiens
tggcccaggaggccagagggca

SEQ ID NO: 10044478 - DNA, 22 bp, Homo sapiens
tggcccaggaggccagagggca

SEQ ID NO: 10044479 - DNA, 22 bp, Homo sapiens
tggcccagggcacagcagggag

SEQ ID NO: 10044480 - DNA, 22 bp, Homo sapiens
tggcccaggggctcttggtgtt

SEQ ID NO: 10044481 - DNA, 22 bp, Homo sapiens
tggcccagggcacagcagggag

SEQ ID NO: 10044482 - DNA, 22 bp, Homo sapiens
tggcccagggtctacagcctca

SEQ ID NO: 10044483 - DNA, 22 bp, Homo sapiens
tggcccaggtctctctgagccc

SEQ ID NO: 10044484 - DNA, 22 bp, Homo sapiens
tggccctgcacccagagcagtt

SEQ ID NO: 10044485 - DNA, 22 bp, Homo sapiens
tggccctgcagaactagcctgg

SEQ ID NO: 10044486 - DNA, 22 bp, Homo sapiens
tggccctgcagaactagcctgg

SEQ ID NO: 10044487 - DNA, 22 bp, Homo sapiens
tggccctgagggctcggagcca

SEQ ID NO: 10044488 - DNA, 22 bp, Homo sapiens
tggccctgaggacccagtgtgg

SEQ ID NO: 10044489 - DNA, 22 bp, Homo sapiens
tggccctgaggggctgtgcccc

SEQ ID NO: 10044490 - DNA, 22 bp, Homo sapiens
tggccctgaggggctgtgcccc

SEQ ID NO: 10044491 - DNA, 22 bp, Homo sapiens
tggccctgacttggaggcctga

SEQ ID NO: 10044492 - DNA, 22 bp, Homo sapiens
tggccctgactgatgtggaggg

SEQ ID NO: 10044493 - DNA, 22 bp, Homo sapiens
tggccctgacacgtggtactgg

SEQ ID NO: 10044494 - DNA, 22 bp, Homo sapiens
tggccctgacaggtcctgggca

SEQ ID NO: 10044495 - DNA, 22 bp, Homo sapiens
tggcccagtagaaaagggatcg

SEQ ID NO: 10044496 - DNA, 22 bp, Homo sapiens
tggcccaggtgcacccagaggc

SEQ ID NO: 10044497 - DNA, 22 bp, Homo sapiens
tggcccaggtgcaagagacaga

SEQ ID NO: 10044498 - DNA, 22 bp, Homo sapiens
tggcccgccggaagaagatgtc

SEQ ID NO: 10044499 - DNA, 22 bp, Homo sapiens
tggcccagtatgtataatctta

SEQ ID NO: 10044500 - DNA, 22 bp, Homo sapiens
tggcccagtcagcaggagaggg

SEQ ID NO: 10044501 - DNA, 22 bp, Homo sapiens
tggccctgaaggccttgagcat

SEQ ID NO: 10044502 - DNA, 23 bp, Homo sapiens
tggccctgaatctgtcctggagg

SEQ ID NO: 10044503 - DNA, 22 bp, Homo sapiens
tggccctgaatcaaggccagca

SEQ ID NO: 10044504 - DNA, 17 bp, Homo sapiens
tggccctagactccagc

SEQ ID NO: 10044505 - DNA, 22 bp, Homo sapiens
tggccctatttggaaatagagc

SEQ ID NO: 10044506 - DNA, 22 bp, Homo sapiens
tggccctgtccctggagcctgg

SEQ ID NO: 10044507 - DNA, 22 bp, Homo sapiens
tggccctgtcctcatttcatct

SEQ ID NO: 10044508 - DNA, 22 bp, Homo sapiens
tggccctgtgactgagttctag

SEQ ID NO: 10044509 - DNA, 22 bp, Homo sapiens
tggccctgtctgcacacaggat

SEQ ID NO: 10044510 - DNA, 22 bp, Homo sapiens
tggccctgggtggaatgtccca

SEQ ID NO: 10044511 - DNA, 22 bp, Homo sapiens
tggccctgggcatctttcgtga

SEQ ID NO: 10044512 - DNA, 22 bp, Homo sapiens
tggccctggtggcacagcctgc

SEQ ID NO: 10044513 - DNA, 22 bp, Homo sapiens
tggccctgggcagaggcaacat

SEQ ID NO: 10044514 - DNA, 22 bp, Homo sapiens
tggccctggctgagttagattt

SEQ ID NO: 10044515 - DNA, 21 bp, Homo sapiens
tggccctggccacggctgcca

SEQ ID NO: 10044516 - DNA, 21 bp, Homo sapiens
tggccctggccacggctgcca

SEQ ID NO: 10044517 - DNA, 22 bp, Homo sapiens
tggccctgccgcactatcctca

SEQ ID NO: 10044518 - DNA, 22 bp, Homo sapiens
tggccctgccctcttcatcttt

SEQ ID NO: 10044519 - DNA, 22 bp, Homo sapiens
tggccctgccactcactgctga

SEQ ID NO: 10044520 - DNA, 22 bp, Homo sapiens
tggccctgccactcactgctga

SEQ ID NO: 10044521 - DNA, 22 bp, Homo sapiens
tggccctgtgtgcaggctgcac

SEQ ID NO: 10044522 - DNA, 22 bp, Homo sapiens
tggccctgtgtcctgctgccag

SEQ ID NO: 10044523 - DNA, 22 bp, Homo sapiens
tggccctgtgtcctgctgccag

SEQ ID NO: 10044524 - DNA, 22 bp, Homo sapiens
tggccctgtggcttcagaacag

SEQ ID NO: 10044525 - DNA, 22 bp, Homo sapiens
tggccctgtggaggtcagtgag

SEQ ID NO: 10044526 - DNA, 22 bp, Homo sapiens
tggccctgtggcttcagaacag

SEQ ID NO: 10044527 - DNA, 23 bp, Homo sapiens
tggccctgtgcatgctgcttccc

SEQ ID NO: 10044528 - DNA, 23 bp, Homo sapiens
tggccctgtgcatgctgcttccc

SEQ ID NO: 10044529 - DNA, 22 bp, Homo sapiens
tggccctgttctgtacctcata

SEQ ID NO: 10044530 - DNA, 20 bp, Homo sapiens
tggccctgttttctccaggc

SEQ ID NO: 10044531 - DNA, 22 bp, Homo sapiens
tggccctgttctgtacctcata

SEQ ID NO: 10044532 - DNA, 20 bp, Homo sapiens
tggccctgttttctccaggc

SEQ ID NO: 10044533 - DNA, 22 bp, Homo sapiens
tggcctagagaagccaaaagat

SEQ ID NO: 10044534 - DNA, 22 bp, Homo sapiens
tggcctcaaccgtcctaagcac

SEQ ID NO: 10044535 - DNA, 22 bp, Homo sapiens
tggccactcctccctgcaggct

SEQ ID NO: 10044536 - DNA, 22 bp, Homo sapiens
tggccactcagggatgcaggaa

SEQ ID NO: 10044537 - DNA, 23 bp, Homo sapiens
tggccacagtccatgcatgccca

SEQ ID NO: 10044538 - DNA, 22 bp, Homo sapiens
tggccacactgcccccactggg

SEQ ID NO: 10044539 - DNA, 22 bp, Homo sapiens
tggccaggcctcttggtgccca

SEQ ID NO: 10044540 - DNA, 22 bp, Homo sapiens
tggccagtaatagcttctggtg

SEQ ID NO: 10044541 - DNA, 21 bp, Homo sapiens
tggccagctggagtctccaca

SEQ ID NO: 10044542 - DNA, 22 bp, Homo sapiens
tggccagccctcttcccacact

SEQ ID NO: 10044543 - DNA, 22 bp, Homo sapiens
tggccagcacttagcccttacc

SEQ ID NO: 10044544 - DNA, 22 bp, Homo sapiens
tggcagtccagaccctggactc

SEQ ID NO: 10044545 - DNA, 22 bp, Homo sapiens
acagatgatttttatgaaaaca

SEQ ID NO: 10044546 - DNA, 22 bp, Homo sapiens
agctcctgctctttgtccctaa

SEQ ID NO: 10044547 - DNA, 22 bp, Homo sapiens
acacttttagctatgagttaat

SEQ ID NO: 10044548 - DNA, 22 bp, Homo sapiens
acacttttgtgtatatccagtt

SEQ ID NO: 10044549 - DNA, 22 bp, Homo sapiens
agcagagcctgggctaggggtg

SEQ ID NO: 10044550 - DNA, 22 bp, Homo sapiens
aattaaaaaaggagagcttgct

SEQ ID NO: 10044551 - DNA, 22 bp, Homo sapiens
acaatagacaaagtgaatggct

SEQ ID NO: 10044552 - DNA, 22 bp, Homo sapiens
aattgctaaagattatgttttc

SEQ ID NO: 10044553 - DNA, 22 bp, Homo sapiens
actggccatgaacttgggatct

SEQ ID NO: 10044554 - DNA, 22 bp, Homo sapiens
actggccatgggatttatattt

SEQ ID NO: 10044555 - DNA, 22 bp, Homo sapiens
actggccaggcagcagtagctt

SEQ ID NO: 10044556 - DNA, 22 bp, Homo sapiens
actggccaggttcaaaatacag

SEQ ID NO: 10044557 - DNA, 22 bp, Homo sapiens
actggccaggcgaaccacactg

SEQ ID NO: 10044558 - DNA, 22 bp, Homo sapiens
actggccaggcacagctgtggg

SEQ ID NO: 10044559 - DNA, 22 bp, Homo sapiens
actggccagccaacaacaatag

SEQ ID NO: 10044560 - DNA, 22 bp, Homo sapiens
actggccaggagctggaaatac

SEQ ID NO: 10044561 - DNA, 22 bp, Homo sapiens
actggccagaactaagtcacat

SEQ ID NO: 10044562 - DNA, 22 bp, Homo sapiens
actctggccctcctgctgccag

SEQ ID NO: 10044563 - DNA, 22 bp, Homo sapiens
actctggccatcttggaccttg

SEQ ID NO: 10044564 - DNA, 22 bp, Homo sapiens
aatcacatctcattcaacagcc

SEQ ID NO: 10044565 - DNA, 22 bp, Homo sapiens
agaaattcaattctaattagct

SEQ ID NO: 10044566 - DNA, 22 bp, Homo sapiens
agaaattctaagcatcaatagc

SEQ ID NO: 10044567 - DNA, 22 bp, Homo sapiens
acccagagtcatgtttattccc

SEQ ID NO: 10044568 - DNA, 19 bp, Homo sapiens
acccagagccctttgcagg

SEQ ID NO: 10044569 - DNA, 22 bp, Homo sapiens
acccagagctgggcttggcaaa

SEQ ID NO: 10044570 - DNA, 22 bp, Homo sapiens
accatgttggccaagctggtct

SEQ ID NO: 10044571 - DNA, 22 bp, Homo sapiens
acatttaaatacctatgtttct

SEQ ID NO: 10044572 - DNA, 19 bp, Homo sapiens
acatttaaattcagatctc

SEQ ID NO: 10044573 - DNA, 22 bp, Homo sapiens
acagcctggactggctctctgc

SEQ ID NO: 10044574 - DNA, 22 bp, Homo sapiens
acatatgaggtgttattctatg

SEQ ID NO: 10044575 - DNA, 22 bp, Homo sapiens
acagtcttgagcatcagccaga

SEQ ID NO: 10044576 - DNA, 22 bp, Homo sapiens
acagtcttgctgtatggtcagg

SEQ ID NO: 10044577 - DNA, 22 bp, Homo sapiens
acacatttctaaatttttaccg

SEQ ID NO: 10044578 - DNA, 22 bp, Homo sapiens
acacatttacatgtttacgtat

SEQ ID NO: 10044579 - DNA, 22 bp, Homo sapiens
acacattctttaaatgtctgtt

SEQ ID NO: 10044580 - DNA, 22 bp, Homo sapiens
acagcctgctgcctgcttcttg

SEQ ID NO: 10044581 - DNA, 22 bp, Homo sapiens
aagcagcttttgaagagtgagg

SEQ ID NO: 10044582 - DNA, 22 bp, Homo sapiens
aatttcagatgtcataaatata

SEQ ID NO: 10044583 - DNA, 22 bp, Homo sapiens
aacagcttagaaatgttgctaa

SEQ ID NO: 10044584 - DNA, 22 bp, Homo sapiens
aacagcttgagactggatatgc

SEQ ID NO: 10044585 - DNA, 22 bp, Homo sapiens
aacagcttcatcacatggcata

SEQ ID NO: 10044586 - DNA, 22 bp, Homo sapiens
aacagcttactcaatggtgatt

SEQ ID NO: 10044587 - DNA, 22 bp, Homo sapiens
aatagagtcagttctacattct

SEQ ID NO: 10044588 - DNA, 22 bp, Homo sapiens
aatagatactacttagatgtag

SEQ ID NO: 10044589 - DNA, 22 bp, Homo sapiens
aatagatactacttagatgtag

SEQ ID NO: 10044590 - DNA, 22 bp, Homo sapiens
aaccttttgcaagtgccttgac

SEQ ID NO: 10044591 - DNA, 22 bp, Homo sapiens
aaccatttgccattatcttaag

SEQ ID NO: 10044592 - DNA, 22 bp, Homo sapiens
aaccatttgcagttactgagac

SEQ ID NO: 10044593 - DNA, 22 bp, Homo sapiens
aaactgctggttgctggccagc

SEQ ID NO: 10044594 - DNA, 22 bp, Homo sapiens
aaactgcctcctgggcaactaa

SEQ ID NO: 10044595 - DNA, 22 bp, Homo sapiens
aaaatattttagggccaggaga

SEQ ID NO: 10044596 - DNA, 22 bp, Homo sapiens
aaacagcttgtttcaggaaagt

SEQ ID NO: 10044597 - DNA, 22 bp, Homo sapiens
aaacagctttcagaatctctca

SEQ ID NO: 10044598 - DNA, 22 bp, Homo sapiens
aaaactcctgaaattgtttccc

SEQ ID NO: 10044599 - DNA, 22 bp, Homo sapiens
aaacagataatgctataaatgg

SEQ ID NO: 10044600 - DNA, 22 bp, Homo sapiens
aaacagctaagtacattcaagg

SEQ ID NO: 10044601 - DNA, 22 bp, Homo sapiens
aaacagctacttctgtataatg

SEQ ID NO: 10044602 - DNA, 22 bp, Homo sapiens
aaacagctaatggccaggaata

SEQ ID NO: 10044603 - DNA, 20 bp, Homo sapiens
aaacagctaaaccagctctc

SEQ ID NO: 10044604 - DNA, 22 bp, Homo sapiens
aaacagctggtctcaaatgttc

SEQ ID NO: 10044605 - DNA, 22 bp, Homo sapiens
aaacagctgggaggtagaggcg

SEQ ID NO: 10044606 - DNA, 22 bp, Homo sapiens
aaacagctgcagtacacggcct

SEQ ID NO: 10044607 - DNA, 22 bp, Homo sapiens
aaacagctgcactgctgatgtc

SEQ ID NO: 10044608 - DNA, 22 bp, Homo sapiens
aaacagctccttagtttccatc

SEQ ID NO: 10044609 - DNA, 22 bp, Homo sapiens
aaacagctcaagaagttactct

SEQ ID NO: 10044610 - DNA, 22 bp, Homo sapiens
aaacattcacatttgctagtaa

SEQ ID NO: 10044611 - DNA, 22 bp, Homo sapiens
aaatagtttagctctcatttca

SEQ ID NO: 10044612 - DNA, 22 bp, Homo sapiens
aaatagttgtttggatcaataa

SEQ ID NO: 10044613 - DNA, 22 bp, Homo sapiens
aaatagttcagccacggtgact

SEQ ID NO: 10044614 - DNA, 22 bp, Homo sapiens
aaatagttcagcttgtaaaccc

SEQ ID NO: 10044615 - DNA, 22 bp, Homo sapiens
aaatagttagccctgcatatat

SEQ ID NO: 10044616 - DNA, 22 bp, Homo sapiens
aagaggtaaccatagcaaccac

SEQ ID NO: 10044617 - DNA, 22 bp, Homo sapiens
aagaggtaatgactgcttgagt

SEQ ID NO: 10044618 - DNA, 21 bp, Homo sapiens
actgcctgtctccatagtcta

SEQ ID NO: 10044619 - DNA, 22 bp, Homo sapiens
actgcaacctccacctcctggg

SEQ ID NO: 10044620 - DNA, 22 bp, Homo sapiens
actgcaacctccacctcctggg

SEQ ID NO: 10044621 - DNA, 22 bp, Homo sapiens
actgcaacacctcctgggttca

SEQ ID NO: 10044622 - DNA, 23 bp, Homo sapiens
actgctgtctttgaagtgcttga

SEQ ID NO: 10044623 - DNA, 22 bp, Homo sapiens
actccagaatcctagggtcagc

SEQ ID NO: 10044624 - DNA, 22 bp, Homo sapiens
actccaggcatctgcttctgct

SEQ ID NO: 10044625 - DNA, 22 bp, Homo sapiens
agtctctgggcatggttgtgac

SEQ ID NO: 10044626 - DNA, 22 bp, Homo sapiens
agtctctgtcgtagatcagcgt

SEQ ID NO: 10044627 - DNA, 22 bp, Homo sapiens
agtctctgctggttgtgcctat

SEQ ID NO: 10044628 - DNA, 22 bp, Homo sapiens
agtctctgccagcttgtcctct

SEQ ID NO: 10044629 - DNA, 22 bp, Homo sapiens
agtctctgcatgcctgctgtgc

SEQ ID NO: 10044630 - DNA, 22 bp, Homo sapiens
acctcccagctctgagcttggg

SEQ ID NO: 10044631 - DNA, 22 bp, Homo sapiens
aggtactaccagggattttcag

SEQ ID NO: 10044632 - DNA, 22 bp, Homo sapiens
actatatacacattatcttgtt

SEQ ID NO: 10044633 - DNA, 22 bp, Homo sapiens
actaaatacacacatttgttca

SEQ ID NO: 10044634 - DNA, 22 bp, Homo sapiens
actaaatagttttgacagaaca

SEQ ID NO: 10044635 - DNA, 22 bp, Homo sapiens
acctgtttggaggaggtgttag

SEQ ID NO: 10044636 - DNA, 22 bp, Homo sapiens
acctgttttcctatctagattg

SEQ ID NO: 10044637 - DNA, 22 bp, Homo sapiens
acctgtttgtgtccattagtga

SEQ ID NO: 10044638 - DNA, 22 bp, Homo sapiens
accttattaaaatgatgatgta

SEQ ID NO: 10044639 - DNA, 22 bp, Homo sapiens
accttattttgaaatagattgt

SEQ ID NO: 10044640 - DNA, 22 bp, Homo sapiens
acttgcattatatttatcacaa

SEQ ID NO: 10044641 - DNA, 22 bp, Homo sapiens
actgtgtcctatttccttgaca

SEQ ID NO: 10044642 - DNA, 22 bp, Homo sapiens
acttagaattaaatatttttgg

SEQ ID NO: 10044643 - DNA, 22 bp, Homo sapiens
atatattacaaaagaggaagga

SEQ ID NO: 10044644 - DNA, 22 bp, Homo sapiens
atatattcttaaagaatctgac

SEQ ID NO: 10044645 - DNA, 22 bp, Homo sapiens
atataatagtttcataaaggct

SEQ ID NO: 10044646 - DNA, 21 bp, Homo sapiens
atcacattggctgttattatt

SEQ ID NO: 10044647 - DNA, 21 bp, Homo sapiens
atcacattggctgttattatt

SEQ ID NO: 10044648 - DNA, 22 bp, Homo sapiens
atcacattgttagcatagactg

SEQ ID NO: 10044649 - DNA, 22 bp, Homo sapiens
atcactgtcgtcatctgagatt

SEQ ID NO: 10044650 - DNA, 22 bp, Homo sapiens
atcactgtgtatgtatatgcag

SEQ ID NO: 10044651 - DNA, 22 bp, Homo sapiens
atccagagtaatacagaatgca

SEQ ID NO: 10044652 - DNA, 22 bp, Homo sapiens
acagctcttaggcagaaccaac

SEQ ID NO: 10044653 - DNA, 22 bp, Homo sapiens
acagctcagacatcactgctct

SEQ ID NO: 10044654 - DNA, 22 bp, Homo sapiens
acagctcatttgtaaaacggag

SEQ ID NO: 10044655 - DNA, 22 bp, Homo sapiens
agctgctactgctctgccagag

SEQ ID NO: 10044656 - DNA, 22 bp, Homo sapiens
acagcctgcagccccaggtcgc

SEQ ID NO: 10044657 - DNA, 19 bp, Homo sapiens
aggaatggaattaattctg

SEQ ID NO: 10044658 - DNA, 22 bp, Homo sapiens
acataaatagattattgggagg

SEQ ID NO: 10044659 - DNA, 22 bp, Homo sapiens
accattttgggtattttcagag

SEQ ID NO: 10044660 - DNA, 22 bp, Homo sapiens
acatttttattcatcaaagcag

SEQ ID NO: 10044661 - DNA, 22 bp, Homo sapiens
acattttttagagtcccacatt

SEQ ID NO: 10044662 - DNA, 22 bp, Homo sapiens
acatttaaccaaactgtttaat

SEQ ID NO: 10044663 - DNA, 22 bp, Homo sapiens
acatttatataactcactagga

SEQ ID NO: 10044664 - DNA, 23 bp, Homo sapiens
acatgatacacaattagcaaacc

SEQ ID NO: 10044665 - DNA, 22 bp, Homo sapiens
agcccggcttccccggttgcta

SEQ ID NO: 10044666 - DNA, 22 bp, Homo sapiens
agctcagaactgcagacatgtg

SEQ ID NO: 10044667 - DNA, 22 bp, Homo sapiens
agctcagaagcctatgcatagt

SEQ ID NO: 10044668 - DNA, 23 bp, Homo sapiens
agcaggtaggttgaaattttcct

SEQ ID NO: 10044669 - DNA, 22 bp, Homo sapiens
agcataagttggtacagccact

SEQ ID NO: 10044670 - DNA, 22 bp, Homo sapiens
agcactgttatgggatgactta

SEQ ID NO: 10044671 - DNA, 22 bp, Homo sapiens
caaatattccaggtacatccct

SEQ ID NO: 10044672 - DNA, 22 bp, Homo sapiens
caactcctccccagcatgccaa

SEQ ID NO: 10044673 - DNA, 22 bp, Homo sapiens
caactcctggctgttaggcaca

SEQ ID NO: 10044674 - DNA, 22 bp, Homo sapiens
atttcattgaagttaattcttc

SEQ ID NO: 10044675 - DNA, 22 bp, Homo sapiens
agatggtaatcacatttatctg

SEQ ID NO: 10044676 - DNA, 22 bp, Homo sapiens
agaggtatatattctccatatt

SEQ ID NO: 10044677 - DNA, 22 bp, Homo sapiens
atttattattgtggttacttct

SEQ ID NO: 10044678 - DNA, 22 bp, Homo sapiens
atttattatgggatttggctca

SEQ ID NO: 10044679 - DNA, 22 bp, Homo sapiens
attcacagttactgctgaacca

SEQ ID NO: 10044680 - DNA, 22 bp, Homo sapiens
attataaatattttctaggggt

SEQ ID NO: 10044681 - DNA, 22 bp, Homo sapiens
attataaagaacatgtgtgtgg

SEQ ID NO: 10044682 - DNA, 17 bp, Homo sapiens
atgttaatttcacattt

SEQ ID NO: 10044683 - DNA, 22 bp, Homo sapiens
attataaacctttgagggtggg

SEQ ID NO: 10044684 - DNA, 19 bp, Homo sapiens
attagcatgcttgaggatg

SEQ ID NO: 10044685 - DNA, 22 bp, Homo sapiens
attagcatattaaatagtcatt

SEQ ID NO: 10044686 - DNA, 22 bp, Homo sapiens
attaaatactgcaggctaagca

SEQ ID NO: 10044687 - DNA, 22 bp, Homo sapiens
atgccactgcgctccagcctgg

SEQ ID NO: 10044688 - DNA, 22 bp, Homo sapiens
atggaagactaacagaaacatg

SEQ ID NO: 10044689 - DNA, 22 bp, Homo sapiens
atggaagctgaaaaagacacgg

SEQ ID NO: 10044690 - DNA, 22 bp, Homo sapiens
atggtacaaaatgtataaagtc

SEQ ID NO: 10044691 - DNA, 22 bp, Homo sapiens
atggtacaatgtgtttgttagg

SEQ ID NO: 10044692 - DNA, 22 bp, Homo sapiens
cttttattttgaattaagggct

SEQ ID NO: 10044693 - DNA, 22 bp, Homo sapiens
cttgtaattataatgtactgtt

SEQ ID NO: 10044694 - DNA, 22 bp, Homo sapiens
atgcatatgccgtagaataagt

SEQ ID NO: 10044695 - DNA, 22 bp, Homo sapiens
atgagttcaattgtttcagtca

SEQ ID NO: 10044696 - DNA, 23 bp, Homo sapiens
atgaggtaaagatcagctttaaa

SEQ ID NO: 10044697 - DNA, 22 bp, Homo sapiens
atgaggtactagtatatacgta

SEQ ID NO: 10044698 - DNA, 22 bp, Homo sapiens
atgaggtatctcatttcctgaa

SEQ ID NO: 10044699 - DNA, 22 bp, Homo sapiens
atgaggtagtattagaaggaga

SEQ ID NO: 10044700 - DNA, 22 bp, Homo sapiens
atgaggtattcgtaatatttcc

SEQ ID NO: 10044701 - DNA, 22 bp, Homo sapiens
atgaggcagtacacacaaagcc

SEQ ID NO: 10044702 - DNA, 22 bp, Homo sapiens
attggaaatacagtagaaaaat

SEQ ID NO: 10044703 - DNA, 22 bp, Homo sapiens
attggcaaggctgcggtgtctg

SEQ ID NO: 10044704 - DNA, 22 bp, Homo sapiens
caaacattccgcttctcccagg

SEQ ID NO: 10044705 - DNA, 22 bp, Homo sapiens
attagaattatgcttgctaatg

SEQ ID NO: 10044706 - DNA, 22 bp, Homo sapiens
attagacatcatatgattcagc

SEQ ID NO: 10044707 - DNA, 20 bp, Homo sapiens
attattcatacatgtgtgac

SEQ ID NO: 10044708 - DNA, 22 bp, Homo sapiens
attagagaatgtgctgacattg

SEQ ID NO: 10044709 - DNA, 22 bp, Homo sapiens
attagagaaatgttgccaagat

SEQ ID NO: 10044710 - DNA, 22 bp, Homo sapiens
attattcaatcatattaaaagt

SEQ ID NO: 10044711 - DNA, 22 bp, Homo sapiens
attattcagtcttgtaaggagt

SEQ ID NO: 10044712 - DNA, 22 bp, Homo sapiens
attaatattggttcattagctg

SEQ ID NO: 10044713 - DNA, 22 bp, Homo sapiens
attaatatacactgttagcatg

SEQ ID NO: 10044714 - DNA, 22 bp, Homo sapiens
attaatcatttctgcattatct

SEQ ID NO: 10044715 - DNA, 22 bp, Homo sapiens
attcttatttaaatagagtctg

SEQ ID NO: 10044716 - DNA, 22 bp, Homo sapiens
attctattttttaagaagtagt

SEQ ID NO: 10044717 - DNA, 22 bp, Homo sapiens
gcagagcttctgtccttcagga

SEQ ID NO: 10044718 - DNA, 22 bp, Homo sapiens
caacatttcaaggtctttagga

SEQ ID NO: 10044719 - DNA, 21 bp, Homo sapiens
gctgcatcaatctacccaggg

SEQ ID NO: 10044720 - DNA, 22 bp, Homo sapiens
gctcctcttctcccactgaatg

SEQ ID NO: 10044721 - DNA, 19 bp, Homo sapiens
gctcctggatgacctgtgg

SEQ ID NO: 10044722 - DNA, 18 bp, Homo sapiens
gctcctggagtctgactc

SEQ ID NO: 10044723 - DNA, 22 bp, Homo sapiens
gctcctggagagattgagaaag

SEQ ID NO: 10044724 - DNA, 18 bp, Homo sapiens
gctcctggaccaggtcac

SEQ ID NO: 10044725 - DNA, 22 bp, Homo sapiens
gctgtctccccgcacccgaccg

SEQ ID NO: 10044726 - DNA, 22 bp, Homo sapiens
ggcatagatttctttaggttta

SEQ ID NO: 10044727 - DNA, 22 bp, Homo sapiens
cacccagagcctgagagggata

SEQ ID NO: 10044728 - DNA, 22 bp, Homo sapiens
ggcagcatttagagcacagtgt

SEQ ID NO: 10044729 - DNA, 22 bp, Homo sapiens
ggcagcatcacttgtctccagc

SEQ ID NO: 10044730 - DNA, 22 bp, Homo sapiens
cacagcttatgccactgattgg

SEQ ID NO: 10044731 - DNA, 22 bp, Homo sapiens
cacagcttcagtttctgacttg

SEQ ID NO: 10044732 - DNA, 22 bp, Homo sapiens
cacagcttagaaaagaagccat

SEQ ID NO: 10044733 - DNA, 22 bp, Homo sapiens
cacagcttccattagaatgaga

SEQ ID NO: 10044734 - DNA, 22 bp, Homo sapiens
cacagcttcccaaagtggacct

SEQ ID NO: 10044735 - DNA, 22 bp, Homo sapiens
cacagcttcccgtgcatggaga

SEQ ID NO: 10044736 - DNA, 22 bp, Homo sapiens
cacagcttgtttagtgactcac

SEQ ID NO: 10044737 - DNA, 22 bp, Homo sapiens
cacagcttgggctctgacaata

SEQ ID NO: 10044738 - DNA, 22 bp, Homo sapiens
cacagcttctgtctgacccatg

SEQ ID NO: 10044739 - DNA, 22 bp, Homo sapiens
cacagcttcttccattccactc

SEQ ID NO: 10044740 - DNA, 20 bp, Homo sapiens
cacagcttgccttttatgac

SEQ ID NO: 10044741 - DNA, 22 bp, Homo sapiens
cacagcttctgagtgaggattt

SEQ ID NO: 10044742 - DNA, 22 bp, Homo sapiens
cacagcttctccttgatatcgc

SEQ ID NO: 10044743 - DNA, 22 bp, Homo sapiens
cacagcttctccccgctgcggc

SEQ ID NO: 10044744 - DNA, 22 bp, Homo sapiens
cagagtaaacctgtcatcaaga

SEQ ID NO: 10044745 - DNA, 22 bp, Homo sapiens
cagaggtagccgagtgcaatcg

SEQ ID NO: 10044746 - DNA, 22 bp, Homo sapiens
gggcacagaagtctaagacatc

SEQ ID NO: 10044747 - DNA, 22 bp, Homo sapiens
cactggcccattcctgtctggc

SEQ ID NO: 10044748 - DNA, 21 bp, Homo sapiens
gtatcacatttgcatgcttat

SEQ ID NO: 10044749 - DNA, 22 bp, Homo sapiens
gtatcacttttgagagtgagaa

SEQ ID NO: 10044750 - DNA, 22 bp, Homo sapiens
gtatcacttttgagagtgagaa

SEQ ID NO: 10044751 - DNA, 22 bp, Homo sapiens
agttggcattttatttaagtat

SEQ ID NO: 10044752 - DNA, 22 bp, Homo sapiens
ctgagggtcaacttgattgtat

SEQ ID NO: 10044753 - DNA, 22 bp, Homo sapiens
ataaatagtgctgccatgagta

SEQ ID NO: 10044754 - DNA, 22 bp, Homo sapiens
ataaatagtgtgtcataaagtc

SEQ ID NO: 10044755 - DNA, 22 bp, Homo sapiens
ataaatagtgtgtcataaagtc

SEQ ID NO: 10044756 - DNA, 22 bp, Homo sapiens
ataaatatcactgttgtccctc

SEQ ID NO: 10044757 - DNA, 22 bp, Homo sapiens
agttgtcagtcaaagacatttg

SEQ ID NO: 10044758 - DNA, 22 bp, Homo sapiens
ataatatttggataggacagta

SEQ ID NO: 10044759 - DNA, 22 bp, Homo sapiens
ctgcttctccaaagtaggactt

SEQ ID NO: 10044760 - DNA, 22 bp, Homo sapiens
ctgcttctgggatgatggagta

SEQ ID NO: 10044761 - DNA, 22 bp, Homo sapiens
atcacagtttacaaacctgctg

SEQ ID NO: 10044762 - DNA, 22 bp, Homo sapiens
atcacagttttgtgccttgtgg

SEQ ID NO: 10044763 - DNA, 22 bp, Homo sapiens
atcacagtggctacctctggat

SEQ ID NO: 10044764 - DNA, 22 bp, Homo sapiens
atcacagtgtagaccttttaaa

SEQ ID NO: 10044765 - DNA, 22 bp, Homo sapiens
atcacagttactcaaataatga

SEQ ID NO: 10044766 - DNA, 22 bp, Homo sapiens
atcacagtgccttcgtaaattt

SEQ ID NO: 10044767 - DNA, 22 bp, Homo sapiens
atatatagagctagatgttaaa

SEQ ID NO: 10044768 - DNA, 20 bp, Homo sapiens
atataataaattttggttac

SEQ ID NO: 10044769 - DNA, 22 bp, Homo sapiens
atataagtgtgtggctgttagt

SEQ ID NO: 10044770 - DNA, 22 bp, Homo sapiens
atataatacaacctgctaagtg

SEQ ID NO: 10044771 - DNA, 22 bp, Homo sapiens
atatgattgtccttagcaaatt

SEQ ID NO: 10044772 - DNA, 22 bp, Homo sapiens
agggtctgtggatgcatctggg

SEQ ID NO: 10044773 - DNA, 22 bp, Homo sapiens
agggtctgcattccaacttggg

SEQ ID NO: 10044774 - DNA, 21 bp, Homo sapiens
cctggccaatctgatagggtt

SEQ ID NO: 10044775 - DNA, 22 bp, Homo sapiens
cctggccaatctagggctgtta

SEQ ID NO: 10044776 - DNA, 22 bp, Homo sapiens
cctggccacagggctctgcatt

SEQ ID NO: 10044777 - DNA, 20 bp, Homo sapiens
cctggccaatgagataggaa

SEQ ID NO: 10044778 - DNA, 22 bp, Homo sapiens
cctggccacccagccttggcca

SEQ ID NO: 10044779 - DNA, 22 bp, Homo sapiens
cctggccactcaggtgtggggc

SEQ ID NO: 10044780 - DNA, 19 bp, Homo sapiens
cctggccagacttctgccc

SEQ ID NO: 10044781 - DNA, 22 bp, Homo sapiens
cctggccagaggcgtgcctgtg

SEQ ID NO: 10044782 - DNA, 22 bp, Homo sapiens
cctggaccaaacactggcctgg

SEQ ID NO: 10044783 - DNA, 22 bp, Homo sapiens
aggtgctgggcagcagtcattg

SEQ ID NO: 10044784 - DNA, 22 bp, Homo sapiens
aggtgctgtttgtcagcagttt

SEQ ID NO: 10044785 - DNA, 22 bp, Homo sapiens
ccttttatactcagtgatatca

SEQ ID NO: 10044786 - DNA, 22 bp, Homo sapiens
ccttttataaagttgtattgaa

SEQ ID NO: 10044787 - DNA, 22 bp, Homo sapiens
cgagcatgatgacggctgtggc

SEQ ID NO: 10044788 - DNA, 22 bp, Homo sapiens
ccttttcaactaagattctgca

SEQ ID NO: 10044789 - DNA, 22 bp, Homo sapiens
ccttttatgaacttgagcaggt

SEQ ID NO: 10044790 - DNA, 22 bp, Homo sapiens
cggctcactgcagctccgcctc

SEQ ID NO: 10044791 - DNA, 22 bp, Homo sapiens
agtagtcacttctattaatggc

SEQ ID NO: 10044792 - DNA, 22 bp, Homo sapiens
cggccaagccggggccccgaag

SEQ ID NO: 10044793 - DNA, 22 bp, Homo sapiens
cggccaaattgcagagagaagc

SEQ ID NO: 10044794 - DNA, 21 bp, Homo sapiens
cggccaaattcctcctaggga

SEQ ID NO: 10044795 - DNA, 22 bp, Homo sapiens
cggggttcatccatgctgtggc

SEQ ID NO: 10044796 - DNA, 22 bp, Homo sapiens
cgggttcacgccattctcctgc

SEQ ID NO: 10044797 - DNA, 23 bp, Homo sapiens
ctcagaggtgtttttcacttact

SEQ ID NO: 10044798 - DNA, 22 bp, Homo sapiens
agtgaaattgctgtaagaggaa

SEQ ID NO: 10044799 - DNA, 22 bp, Homo sapiens
agtctccttggcctcaatgcct

SEQ ID NO: 10044800 - DNA, 22 bp, Homo sapiens
agtggtggagagatgaggacac

SEQ ID NO: 10044801 - DNA, 22 bp, Homo sapiens
ctcctgagtagtagcattgtca

SEQ ID NO: 10044802 - DNA, 22 bp, Homo sapiens
ctccttggccgttaatgtcaca

SEQ ID NO: 10044803 - DNA, 22 bp, Homo sapiens
agtgctggcccatagctgctgg

SEQ ID NO: 10044804 - DNA, 22 bp, Homo sapiens
agtgctgggattgcaggcatga

SEQ ID NO: 10044805 - DNA, 22 bp, Homo sapiens
agtgctgggattacaggcataa

SEQ ID NO: 10044806 - DNA, 20 bp, Homo sapiens
aggaagctgagatgtagagg

SEQ ID NO: 10044807 - DNA, 22 bp, Homo sapiens
aggaagctgctaagaaacaatg

SEQ ID NO: 10044808 - DNA, 22 bp, Homo sapiens
aggaagctgggaaactgacatt

SEQ ID NO: 10044809 - DNA, 22 bp, Homo sapiens
cagtctctctgaagtattaaga

SEQ ID NO: 10044810 - DNA, 22 bp, Homo sapiens
cagtctcttgcttcattagttg

SEQ ID NO: 10044811 - DNA, 22 bp, Homo sapiens
cattcaaaagctccatgtttgt

SEQ ID NO: 10044812 - DNA, 22 bp, Homo sapiens
catgcaggcccgcctgaatggg

SEQ ID NO: 10044813 - DNA, 22 bp, Homo sapiens
catgcaggcacccagagcccac

SEQ ID NO: 10044814 - DNA, 21 bp, Homo sapiens
catgcaggatttaacctagaa

SEQ ID NO: 10044815 - DNA, 22 bp, Homo sapiens
cagctttttagaatctagggca

SEQ ID NO: 10044816 - DNA, 22 bp, Homo sapiens
cagctctcacacttagcttcta

SEQ ID NO: 10044817 - DNA, 22 bp, Homo sapiens
aggaaataggaccagacaaagc

SEQ ID NO: 10044818 - DNA, 22 bp, Homo sapiens
aggaagctcattttgacatatc

SEQ ID NO: 10044819 - DNA, 22 bp, Homo sapiens
aggaagctcaaagccatgatgt

SEQ ID NO: 10044820 - DNA, 22 bp, Homo sapiens
agcttaaactctttgaagttat

SEQ ID NO: 10044821 - DNA, 22 bp, Homo sapiens
agctgtgtcctgaagacactgc

SEQ ID NO: 10044822 - DNA, 22 bp, Homo sapiens
aggccaaagcaagaccctgtaa

SEQ ID NO: 10044823 - DNA, 18 bp, Homo sapiens
aggccaaacttgtaagca

SEQ ID NO: 10044824 - DNA, 22 bp, Homo sapiens
aggccaaaccggatggaaaagg

SEQ ID NO: 10044825 - DNA, 16 bp, Homo sapiens
aggccaaaaaggggca

SEQ ID NO: 10044826 - DNA, 20 bp, Homo sapiens
aggccaaacccagcgcgccc

SEQ ID NO: 10044827 - DNA, 22 bp, Homo sapiens
aggccaaagtgctccttttaga

SEQ ID NO: 10044828 - DNA, 22 bp, Homo sapiens
aggccaaagcacagagctggaa

SEQ ID NO: 10044829 - DNA, 22 bp, Homo sapiens
aggccaaagctcacctgcagct

SEQ ID NO: 10044830 - DNA, 22 bp, Homo sapiens
aggccaaattgatcatctttag

SEQ ID NO: 10044831 - DNA, 22 bp, Homo sapiens
aggccaaatgtgtataaaacat

SEQ ID NO: 10044832 - DNA, 22 bp, Homo sapiens
cctcagagacagtaactggaat

SEQ ID NO: 10044833 - DNA, 21 bp, Homo sapiens
tctcccaaggaggtcctgagg

SEQ ID NO: 10044834 - DNA, 22 bp, Homo sapiens
tctcccaaggcacagaaagagt

SEQ ID NO: 10044835 - DNA, 22 bp, Homo sapiens
tctcccaacatgtggaggtcag

SEQ ID NO: 10044836 - DNA, 22 bp, Homo sapiens
tctcctgggaggacaaggaagg

SEQ ID NO: 10044837 - DNA, 22 bp, Homo sapiens
tctcccaagtgaccaggaaaga

SEQ ID NO: 10044838 - DNA, 19 bp, Homo sapiens
ccagaagggcagctatgga

SEQ ID NO: 10044839 - DNA, 20 bp, Homo sapiens
ccagaaggtttgccactttc

SEQ ID NO: 10044840 - DNA, 22 bp, Homo sapiens
tcctggtctacactgcattggg

SEQ ID NO: 10044841 - DNA, 23 bp, Homo sapiens
tcctcccaaatttcagcctcatt

SEQ ID NO: 10044842 - DNA, 22 bp, Homo sapiens
tcctcccacataggacaatggg

SEQ ID NO: 10044843 - DNA, 22 bp, Homo sapiens
ccacagagttgatgcaataaga

SEQ ID NO: 10044844 - DNA, 22 bp, Homo sapiens
ccacagagtccgcatttgaggc

SEQ ID NO: 10044845 - DNA, 19 bp, Homo sapiens
tctgcctctggtcaggctc

SEQ ID NO: 10044846 - DNA, 22 bp, Homo sapiens
cagggtcttataaggccaattt

SEQ ID NO: 10044847 - DNA, 22 bp, Homo sapiens
cagggtcttggcgccatcaccc

SEQ ID NO: 10044848 - DNA, 22 bp, Homo sapiens
tataagatacttggcatagtgc

SEQ ID NO: 10044849 - DNA, 22 bp, Homo sapiens
tataatatgaggcaggagtgat

SEQ ID NO: 10044850 - DNA, 22 bp, Homo sapiens
tattaaatatatctgttagttg

SEQ ID NO: 10044851 - DNA, 22 bp, Homo sapiens
caggtgaaaaagcaaccatatt

SEQ ID NO: 10044852 - DNA, 22 bp, Homo sapiens
cagtctcagaggtgggagtggg

SEQ ID NO: 10044853 - DNA, 22 bp, Homo sapiens
cagtctctaaatcaatctgaat

SEQ ID NO: 10044854 - DNA, 22 bp, Homo sapiens
tattggcagcatgagctcctgg

SEQ ID NO: 10044855 - DNA, 22 bp, Homo sapiens
tattggatgattcacttggcag

SEQ ID NO: 10044856 - DNA, 22 bp, Homo sapiens
tattggatagcttgtgcagaat

SEQ ID NO: 10044857 - DNA, 22 bp, Homo sapiens
tattggaagtgaacaccaggct

SEQ ID NO: 10044858 - DNA, 22 bp, Homo sapiens
cagtgctgggcagaggagagcg

SEQ ID NO: 10044859 - DNA, 22 bp, Homo sapiens
cagtttcttggatgccaatttc

SEQ ID NO: 10044860 - DNA, 22 bp, Homo sapiens
catccagaccgtgccatgctgc

SEQ ID NO: 10044861 - DNA, 22 bp, Homo sapiens
catatattctggttttcactgg

SEQ ID NO: 10044862 - DNA, 21 bp, Homo sapiens
catgataatgaaggtgttatt

SEQ ID NO: 10044863 - DNA, 22 bp, Homo sapiens
tcatttgttctcattctctact

SEQ ID NO: 10044864 - DNA, 17 bp, Homo sapiens
tcatttgttgtgactag

SEQ ID NO: 10044865 - DNA, 22 bp, Homo sapiens
tcatttcaagttctgacagcta

SEQ ID NO: 10044866 - DNA, 22 bp, Homo sapiens
catcttaaattaaagcttaagg

SEQ ID NO: 10044867 - DNA, 22 bp, Homo sapiens
catgtctgtgtacacatgcaca

SEQ ID NO: 10044868 - DNA, 18 bp, Homo sapiens
catgtctgcgccacaagg

SEQ ID NO: 10044869 - DNA, 22 bp, Homo sapiens
catggctgcgagaagagtgggt

SEQ ID NO: 10044870 - DNA, 22 bp, Homo sapiens
caggacactaaaaagccaagct

SEQ ID NO: 10044871 - DNA, 22 bp, Homo sapiens
caggacacatttcttgttcagg

SEQ ID NO: 10044872 - DNA, 22 bp, Homo sapiens
taaaccttggtagcatcttgct

SEQ ID NO: 10044873 - DNA, 22 bp, Homo sapiens
taaatagagaatcagcttggag

SEQ ID NO: 10044874 - DNA, 22 bp, Homo sapiens
tacagcttaaaaaagccaactt

SEQ ID NO: 10044875 - DNA, 22 bp, Homo sapiens
taacttctttggtttaaagaga

SEQ ID NO: 10044876 - DNA, 22 bp, Homo sapiens
gtggtaatagagctccaaacta

SEQ ID NO: 10044877 - DNA, 22 bp, Homo sapiens
gtggtaatcggattcttaccgg

SEQ ID NO: 10044878 - DNA, 22 bp, Homo sapiens
gtggtaatttaatcctacactg

SEQ ID NO: 10044879 - DNA, 22 bp, Homo sapiens
gttcacagtgttttctttgcat

SEQ ID NO: 10044880 - DNA, 22 bp, Homo sapiens
gtttattattcaacttcatgtt

SEQ ID NO: 10044881 - DNA, 22 bp, Homo sapiens
cagcttcatgacaaacagtttt

SEQ ID NO: 10044882 - DNA, 22 bp, Homo sapiens
gttattagaagtgaaggattgt

SEQ ID NO: 10044883 - DNA, 22 bp, Homo sapiens
gttattagtaagactcgcacat

SEQ ID NO: 10044884 - DNA, 22 bp, Homo sapiens
cagctttcatcagtgacactca

SEQ ID NO: 10044885 - DNA, 22 bp, Homo sapiens
tggcagcaccagcagtgtcctt

SEQ ID NO: 10044886 - DNA, 22 bp, Homo sapiens
tggcagcacaaggtggcccatg

SEQ ID NO: 10044887 - DNA, 22 bp, Homo sapiens
tggcagcactaggtactgagct

SEQ ID NO: 10044888 - DNA, 22 bp, Homo sapiens
tggcagcaattagctagagctg

SEQ ID NO: 10044889 - DNA, 22 bp, Homo sapiens
tggccacacccacctagaggag

SEQ ID NO: 10044890 - DNA, 22 bp, Homo sapiens
tggcaagcctgagatccgggag

SEQ ID NO: 10044891 - DNA, 23 bp, Homo sapiens
tggagctgacagtcagagggagg

SEQ ID NO: 10044892 - DNA, 22 bp, Homo sapiens
cctcctctgggaagattcagag

SEQ ID NO: 10044893 - DNA, 22 bp, Homo sapiens
cctgggcatctcatgcacctgc

SEQ ID NO: 10044894 - DNA, 21 bp, Homo sapiens
cctgggccaaattccctggac

SEQ ID NO: 10044895 - DNA, 22 bp, Homo sapiens
cctgggcctgaaaacatttctc

SEQ ID NO: 10044896 - DNA, 22 bp, Homo sapiens
tgtgaaggagatgaagggagtg

SEQ ID NO: 10044897 - DNA, 22 bp, Homo sapiens
tgtgaggtaacgctgctctgtt

SEQ ID NO: 10044898 - DNA, 22 bp, Homo sapiens
tgtaggatgtaaggcaggcatc

SEQ ID NO: 10044899 - DNA, 22 bp, Homo sapiens
tggtggctgttgcagaactgag

SEQ ID NO: 10044900 - DNA, 22 bp, Homo sapiens
tggtgctcccaagattgttcta

SEQ ID NO: 10044901 - DNA, 22 bp, Homo sapiens
tgtctctgggtgattcagtcct

SEQ ID NO: 10044902 - DNA, 22 bp, Homo sapiens
cctggccagtttccaggccctg

SEQ ID NO: 10044903 - DNA, 22 bp, Homo sapiens
cctggccatagggcccaggaaa

SEQ ID NO: 10044904 - DNA, 22 bp, Homo sapiens
cctggccagggtctgggctgct

SEQ ID NO: 10044905 - DNA, 22 bp, Homo sapiens
cctggccaggctccaagtactg

SEQ ID NO: 10044906 - DNA, 22 bp, Homo sapiens
cctggccaggctctcagcactg

SEQ ID NO: 10044907 - DNA, 22 bp, Homo sapiens
cctggccagctaattgcccatc

SEQ ID NO: 10044908 - DNA, 22 bp, Homo sapiens
cctggccaggcatggagtcaca

SEQ ID NO: 10044909 - DNA, 22 bp, Homo sapiens
cctggccagccagggctggggt

SEQ ID NO: 10044910 - DNA, 22 bp, Homo sapiens
cctggccagcgccggctgctcg

SEQ ID NO: 10044911 - DNA, 22 bp, Homo sapiens
cctggccatttgaacttcagac

SEQ ID NO: 10044912 - DNA, 22 bp, Homo sapiens
ctgcctggctaaactcaagtcg

SEQ ID NO: 10044913 - DNA, 22 bp, Homo sapiens
ctggagtctccccaggagcgtg

SEQ ID NO: 10044914 - DNA, 22 bp, Homo sapiens
ctggccatgttgcctctgagac

SEQ ID NO: 10044915 - DNA, 22 bp, Homo sapiens
ctggccagttgccttcctgggt

SEQ ID NO: 10044916 - DNA, 22 bp, Homo sapiens
ctggcccagagctctggccttt

SEQ ID NO: 10044917 - DNA, 22 bp, Homo sapiens
ctggcccaggaagacgtgtccc

SEQ ID NO: 10044918 - DNA, 22 bp, Homo sapiens
ctggccaacttgcttgttggca

SEQ ID NO: 10044919 - DNA, 22 bp, Homo sapiens
ctggccaacatctggggcacat

SEQ ID NO: 10044920 - DNA, 22 bp, Homo sapiens
ctggccaagcttctctaagcag

SEQ ID NO: 10044921 - DNA, 22 bp, Homo sapiens
ctggccaagatggtgaaacccc

SEQ ID NO: 10044922 - DNA, 22 bp, Homo sapiens
ctggccaagcactggggtcaaa

SEQ ID NO: 10044923 - DNA, 22 bp, Homo sapiens
ctggccaatccattaatttgtt

SEQ ID NO: 10044924 - DNA, 22 bp, Homo sapiens
ctggccaatgcctggggaatag

SEQ ID NO: 10044925 - DNA, 22 bp, Homo sapiens
ctggccaatatagggaaatctt

SEQ ID NO: 10044926 - DNA, 22 bp, Homo sapiens
ctggcacatcactcctagttta

SEQ ID NO: 10044927 - DNA, 22 bp, Homo sapiens
ctggcacatgctccctgagtgg

SEQ ID NO: 10044928 - DNA, 22 bp, Homo sapiens
ctgcctcctgccgtgcagcttc

SEQ ID NO: 10044929 - DNA, 22 bp, Homo sapiens
ctgccatctgagccaaaagtgc

SEQ ID NO: 10044930 - DNA, 22 bp, Homo sapiens
ctgagacattatgacaagtgga

SEQ ID NO: 10044931 - DNA, 22 bp, Homo sapiens
ctgagacatggtttgactggca

SEQ ID NO: 10044932 - DNA, 22 bp, Homo sapiens
ctgagacacggagaggctgtgt

SEQ ID NO: 10044933 - DNA, 22 bp, Homo sapiens
ctctcctctgaagtggtgaccc

SEQ ID NO: 10044934 - DNA, 22 bp, Homo sapiens
ttttagttgtagttggtgagga

SEQ ID NO: 10044935 - DNA, 22 bp, Homo sapiens
ttttagttgtactgtcaacagt

SEQ ID NO: 10044936 - DNA, 22 bp, Homo sapiens
ttttattctaagtatgatggga

SEQ ID NO: 10044937 - DNA, 22 bp, Homo sapiens
ctctggcttctaccttgcagtt

SEQ ID NO: 10044938 - DNA, 22 bp, Homo sapiens
ctcatctgataaatcactctta

SEQ ID NO: 10044939 - DNA, 22 bp, Homo sapiens
ttggccaatttagaacgtgttg

SEQ ID NO: 10044940 - DNA, 22 bp, Homo sapiens
ttggccaaatacacaccttttg

SEQ ID NO: 10044941 - DNA, 20 bp, Homo sapiens
ttggccaaatcttagtcatg

SEQ ID NO: 10044942 - DNA, 22 bp, Homo sapiens
ttggccaacagcgacagggcca

SEQ ID NO: 10044943 - DNA, 22 bp, Homo sapiens
ttggccaaataatcttgcagat

SEQ ID NO: 10044944 - DNA, 22 bp, Homo sapiens
ttggccaacatggtgaaacccc

SEQ ID NO: 10044945 - DNA, 22 bp, Homo sapiens
ttggccaaccagaacggaggtc

SEQ ID NO: 10044946 - DNA, 22 bp, Homo sapiens
ttggccaagactcatgtcctat

SEQ ID NO: 10044947 - DNA, 22 bp, Homo sapiens
ttggccaagatacgagcacata

SEQ ID NO: 10044948 - DNA, 22 bp, Homo sapiens
ttggccaaggtcactgggtgag

SEQ ID NO: 10044949 - DNA, 22 bp, Homo sapiens
ttggccaagtcactggttaatg

SEQ ID NO: 10044950 - DNA, 22 bp, Homo sapiens
ttggccaagtggttaatctcca

SEQ ID NO: 10044951 - DNA, 22 bp, Homo sapiens
ttggccaatcctattgggtggg

SEQ ID NO: 10044952 - DNA, 22 bp, Homo sapiens
ttggccaatggtgattcccggc

SEQ ID NO: 10044953 - DNA, 22 bp, Homo sapiens
ttggccaattccagaggatcat

SEQ ID NO: 10044954 - DNA, 22 bp, Homo sapiens
ttggccaaggaagtagcaacgg

SEQ ID NO: 10044955 - DNA, 22 bp, Homo sapiens
ttggccaaggacctttttggag

SEQ ID NO: 10044956 - DNA, 22 bp, Homo sapiens
ttggccaagggatcgaggttgg

SEQ ID NO: 10044957 - DNA, 22 bp, Homo sapiens
ttggccaagggctctttaggct

SEQ ID NO: 10044958 - DNA, 22 bp, Homo sapiens
ttggatgaagtctagctttagt

SEQ ID NO: 10044959 - DNA, 22 bp, Homo sapiens
ttggccaaaggaaagactactg

SEQ ID NO: 10044960 - DNA, 22 bp, Homo sapiens
ttggccaaagctcaccagtgct

SEQ ID NO: 10044961 - DNA, 22 bp, Homo sapiens
ttggccaaacagagttcaacag

SEQ ID NO: 10044962 - DNA, 22 bp, Homo sapiens
ttggccaaaaaagtcattagaa

SEQ ID NO: 10044963 - DNA, 20 bp, Homo sapiens
ctctcctcacccgtgtcagg

SEQ ID NO: 10044964 - DNA, 22 bp, Homo sapiens
ctctcctcagaacaggccctct

SEQ ID NO: 10044965 - DNA, 22 bp, Homo sapiens
ctcctgggctcatatcattcag

SEQ ID NO: 10044966 - DNA, 22 bp, Homo sapiens
ctcctgggctcaagtgatcctc

SEQ ID NO: 10044967 - DNA, 21 bp, Homo sapiens
ctcctgggctaagatatagtg

SEQ ID NO: 10044968 - DNA, 22 bp, Homo sapiens
ctcctgggagtcttcctggatg

SEQ ID NO: 10044969 - DNA, 19 bp, Homo sapiens
ctctcactcgccacatcct

SEQ ID NO: 10044970 - DNA, 22 bp, Homo sapiens
ttcacataatctgcagcaagcg

SEQ ID NO: 10044971 - DNA, 22 bp, Homo sapiens
ctaatttaatgaatgagtctta

SEQ ID NO: 10044972 - DNA, 22 bp, Homo sapiens
ctatttatgtgctattttgtat

SEQ ID NO: 10044973 - DNA, 22 bp, Homo sapiens
ctaggccacttgctctcatgga

SEQ ID NO: 10044974 - DNA, 18 bp, Homo sapiens
ttgataaacaatttcatt

SEQ ID NO: 10044975 - DNA, 22 bp, Homo sapiens
gagaggtaatttgaagtgcaaa

SEQ ID NO: 10044976 - DNA, 22 bp, Homo sapiens
gagagtctaggaacctcatata

SEQ ID NO: 10044977 - DNA, 22 bp, Homo sapiens
gagagtctaggaacctcatata

SEQ ID NO: 10044978 - DNA, 22 bp, Homo sapiens
gagaggtacggaaagagcgtgg

SEQ ID NO: 10044979 - DNA, 22 bp, Homo sapiens
gagaggtacaccctttaaactt

SEQ ID NO: 10044980 - DNA, 22 bp, Homo sapiens
gagacacttgctgtgaggtcgc

SEQ ID NO: 10044981 - DNA, 22 bp, Homo sapiens
gaccagtcattactcatgccct

SEQ ID NO: 10044982 - DNA, 22 bp, Homo sapiens
gaccatttttacagagcattca

SEQ ID NO: 10044983 - DNA, 22 bp, Homo sapiens
gaccatttgctagtaaattgca

SEQ ID NO: 10044984 - DNA, 22 bp, Homo sapiens
gaccatttgttgaaaagattat

SEQ ID NO: 10044985 - DNA, 22 bp, Homo sapiens
gaccatttctaggaatcagact

SEQ ID NO: 10044986 - DNA, 22 bp, Homo sapiens
gaaataattctgtgtctgaaca

SEQ ID NO: 10044987 - DNA, 22 bp, Homo sapiens
cttctcggggttcccgcgccct

SEQ ID NO: 10044988 - DNA, 22 bp, Homo sapiens
cttctcttgggtgtggtgtctt

SEQ ID NO: 10044989 - DNA, 22 bp, Homo sapiens
cttctcttcctttgtcaactga

SEQ ID NO: 10044990 - DNA, 22 bp, Homo sapiens
cttctcttcccagggacacagg

SEQ ID NO: 10044991 - DNA, 22 bp, Homo sapiens
cttctttcttttgatcacaggt

SEQ ID NO: 10044992 - DNA, 22 bp, Homo sapiens
ctttgtatctaaatatcttgaa

SEQ ID NO: 10044993 - DNA, 22 bp, Homo sapiens
ctttgtattcagttgggctgtg

SEQ ID NO: 10044994 - DNA, 22 bp, Homo sapiens
ctttatatccagatgtttggtg

SEQ ID NO: 10044995 - DNA, 22 bp, Homo sapiens
gatataggttcatagtgttaca

SEQ ID NO: 10044996 - DNA, 22 bp, Homo sapiens
gatcatttacttgttctggact

SEQ ID NO: 10044997 - DNA, 19 bp, Homo sapiens
gatataaagagatggtgaa

SEQ ID NO: 10044998 - DNA, 22 bp, Homo sapiens
gatcattttgatgcccttttag

SEQ ID NO: 10044999 - DNA, 22 bp, Homo sapiens
gatcatttgcaggaaacattaa

SEQ ID NO: 10045000 - DNA, 22 bp, Homo sapiens
gatcttggggggatcaccatgg

SEQ ID NO: 10045001 - DNA, 22 bp, Homo sapiens
gagttctattatggttagaagt

SEQ ID NO: 10045002 - DNA, 22 bp, Homo sapiens
gagagtctagtgcacctagttt

SEQ ID NO: 10045003 - DNA, 22 bp, Homo sapiens
gagagtctagtgcacctagttt

SEQ ID NO: 10045004 - DNA, 22 bp, Homo sapiens
gaggggcagaggtagagaacaa

SEQ ID NO: 10045005 - DNA, 22 bp, Homo sapiens
gaggtatcttagagagtgtaga

SEQ ID NO: 10045006 - DNA, 23 bp, Homo sapiens
gaggtcaaggctgcagtgattgc

SEQ ID NO: 10045007 - DNA, 22 bp, Homo sapiens
gaggtaacaactgaaatgagaa

SEQ ID NO: 10045008 - DNA, 22 bp, Homo sapiens
gattaggacatggatgtatgtt

SEQ ID NO: 10045009 - DNA, 22 bp, Homo sapiens
gattaggagggagaggcaagta

SEQ ID NO: 10045010 - DNA, 22 bp, Homo sapiens
gattaatagtacaggttcttag

SEQ ID NO: 10045011 - DNA, 22 bp, Homo sapiens
gattaatagacacaaccaagct

SEQ ID NO: 10045012 - DNA, 21 bp, Homo sapiens
gatgttggaggctggggtctg

SEQ ID NO: 10045013 - DNA, 22 bp, Homo sapiens
gatttggcctttcgcatggtat

SEQ ID NO: 10045014 - DNA, 22 bp, Homo sapiens
gcaccgccttggaccgcccgct

SEQ ID NO: 10045015 - DNA, 22 bp, Homo sapiens
gcaggggctaaggacacagaga

SEQ ID NO: 10045016 - DNA, 22 bp, Homo sapiens
gcctctgcaattacattgtgcc

SEQ ID NO: 10045017 - DNA, 22 bp, Homo sapiens
gcctctgccctcctgggactgc

SEQ ID NO: 10045018 - DNA, 17 bp, Homo sapiens
gcctctgcttgtgtcat

SEQ ID NO: 10045019 - DNA, 22 bp, Homo sapiens
gctggccagggctgctcgcgga

SEQ ID NO: 10045020 - DNA, 22 bp, Homo sapiens
gctggccaggtgctttggttct

SEQ ID NO: 10045021 - DNA, 22 bp, Homo sapiens
gctggccagtgtcccagggatc

SEQ ID NO: 10045022 - DNA, 22 bp, Homo sapiens
gctcactgcaagctctgcctcc

SEQ ID NO: 10045023 - DNA, 22 bp, Homo sapiens
gctcactgccattctctagatg

SEQ ID NO: 10045024 - DNA, 22 bp, Homo sapiens
gctcactgcaacctctgcttcc

SEQ ID NO: 10045025 - DNA, 22 bp, Homo sapiens
gctcactgcaacctctgcctcc

SEQ ID NO: 10045026 - DNA, 22 bp, Homo sapiens
gctcctggccagcacagggccc

SEQ ID NO: 10045027 - DNA, 22 bp, Homo sapiens
gctcctggcatcctgcttttaa

SEQ ID NO: 10045028 - DNA, 22 bp, Homo sapiens
gctcctggcaggcagtgtgtgt

SEQ ID NO: 10045029 - DNA, 22 bp, Homo sapiens
gctcctggctccaggcagccaa

SEQ ID NO: 10045030 - DNA, 22 bp, Homo sapiens
gctcctggctctctgagggctg

SEQ ID NO: 10045031 - DNA, 22 bp, Homo sapiens
gctcctctgtcaaatgagagtg

SEQ ID NO: 10045032 - DNA, 22 bp, Homo sapiens
gctcctgggtgtggctgcccct

SEQ ID NO: 10045033 - DNA, 22 bp, Homo sapiens
gctcctgggctctaccttgcta

SEQ ID NO: 10045034 - DNA, 19 bp, Homo sapiens
gctcctgggcctcactcat

SEQ ID NO: 10045035 - DNA, 16 bp, Homo sapiens
gctcctgggccctcga

SEQ ID NO: 10045036 - DNA, 22 bp, Homo sapiens
gctcctgggccctgggctaact

SEQ ID NO: 10045037 - DNA, 22 bp, Homo sapiens
gctcctggcttcactgacatca

SEQ ID NO: 10045038 - DNA, 22 bp, Homo sapiens
gctcctggctctggccaaggga

SEQ ID NO: 10045039 - DNA, 22 bp, Homo sapiens
gtctggcctgccagctctggtg

SEQ ID NO: 10045040 - DNA, 22 bp, Homo sapiens
gtctggcctttttagcttgtgg

SEQ ID NO: 10045041 - DNA, 16 bp, Homo sapiens
gtctggcctacctgcc

SEQ ID NO: 10045042 - DNA, 22 bp, Homo sapiens
gtctgagcgctggagcttgtgt

SEQ ID NO: 10045043 - DNA, 22 bp, Homo sapiens
gtaaatataaatgctagctgcc

SEQ ID NO: 10045044 - DNA, 22 bp, Homo sapiens
gtaaataactggtaattggggt

SEQ ID NO: 10045045 - DNA, 22 bp, Homo sapiens
gtaaatattaaaggctgctaga

SEQ ID NO: 10045046 - DNA, 22 bp, Homo sapiens
gtgacagtgacagctagatagt

SEQ ID NO: 10045047 - DNA, 18 bp, Homo sapiens
gtggccagcctggtcttg

SEQ ID NO: 10045048 - DNA, 22 bp, Homo sapiens
gtggccaatttccatctgtaag

SEQ ID NO: 10045049 - DNA, 22 bp, Homo sapiens
gtggccaaaaggaagaaggtta

SEQ ID NO: 10045050 - DNA, 22 bp, Homo sapiens
gtggccaaacaccagtttagga

SEQ ID NO: 10045051 - DNA, 22 bp, Homo sapiens
gtggccaacctggccctgaact

SEQ ID NO: 10045052 - DNA, 22 bp, Homo sapiens
gtggccaactcaatgtttttca

SEQ ID NO: 10045053 - DNA, 22 bp, Homo sapiens
gtggccaaatcatgtcaaaggc

SEQ ID NO: 10045054 - DNA, 22 bp, Homo sapiens
gtggccaagagataaaattgtg

SEQ ID NO: 10045055 - DNA, 22 bp, Homo sapiens
gtggccaagaaaatagatgcat

SEQ ID NO: 10045056 - DNA, 22 bp, Homo sapiens
gtggccaataggagcagctatc

SEQ ID NO: 10045057 - DNA, 22 bp, Homo sapiens
gtggccaaggtgcagagcagct

SEQ ID NO: 10045058 - DNA, 22 bp, Homo sapiens
gtggccaagaggggactggata

SEQ ID NO: 10045059 - DNA, 22 bp, Homo sapiens
gtggccaaggcagagaaagagc

SEQ ID NO: 10045060 - DNA, 22 bp, Homo sapiens
gtggccaagggactctaaggca

SEQ ID NO: 10045061 - DNA, 22 bp, Homo sapiens
gtggctgcagcggctgtggaga

SEQ ID NO: 10045062 - DNA, 22 bp, Homo sapiens
taaatgagtaatatagctgttt

SEQ ID NO: 10045063 - DNA, 22 bp, Homo sapiens
taaatgagggctgacatgattg

SEQ ID NO: 10045064 - DNA, 22 bp, Homo sapiens
taaatgaaagggtttaatttat

SEQ ID NO: 10045065 - DNA, 22 bp, Homo sapiens
taacagagatagaaatgtaaag

SEQ ID NO: 10045066 - DNA, 22 bp, Homo sapiens
gtgtcacaggcccagctcttca

SEQ ID NO: 10045067 - DNA, 22 bp, Homo sapiens
gttcaagaccagcctggccaac

SEQ ID NO: 10045068 - DNA, 22 bp, Homo sapiens
gggtctgaggagtaccattgtc

SEQ ID NO: 10045069 - DNA, 21 bp, Homo sapiens
gggtctgaatatctggtgctg

SEQ ID NO: 10045070 - DNA, 22 bp, Homo sapiens
ggcagacacctttatgtctaat

SEQ ID NO: 10045071 - DNA, 22 bp, Homo sapiens
tggcatcatagccaaggtgctt

SEQ ID NO: 10045072 - DNA, 23 bp, Homo sapiens
tggccacagggtgctccattgta

SEQ ID NO: 10045073 - DNA, 22 bp, Homo sapiens
tggccacagtgtccagcagcag

SEQ ID NO: 10045074 - DNA, 22 bp, Homo sapiens
tggccacatcctttccttgtca

SEQ ID NO: 10045075 - DNA, 22 bp, Homo sapiens
tggccacatgcgtctgtgaggc

SEQ ID NO: 10045076 - DNA, 22 bp, Homo sapiens
tggccatagctcagctccttca

SEQ ID NO: 10045077 - DNA, 19 bp, Homo sapiens
tggcagcattggtaccttg

SEQ ID NO: 10045078 - DNA, 22 bp, Homo sapiens
tggcagcattaattattcaggt

SEQ ID NO: 10045079 - DNA, 22 bp, Homo sapiens
tggcagcagacaaaaggccatt

SEQ ID NO: 10045080 - DNA, 22 bp, Homo sapiens
tggcagcagacatctgaggtct

SEQ ID NO: 10045081 - DNA, 18 bp, Homo sapiens
tggcagcaggaagccatt

SEQ ID NO: 10045082 - DNA, 22 bp, Homo sapiens
tggcagcagctaacttaggcag

SEQ ID NO: 10045083 - DNA, 22 bp, Homo sapiens
tggcagcagggcccctggagga

SEQ ID NO: 10045084 - DNA, 22 bp, Homo sapiens
tggcagcagaacatgaaaccca

SEQ ID NO: 10045085 - DNA, 22 bp, Homo sapiens
tggcagcacttgaacttgagcc

SEQ ID NO: 10045086 - DNA, 22 bp, Homo sapiens
tggcaccagcacctagatgggg

SEQ ID NO: 10045087 - DNA, 22 bp, Homo sapiens
tggcaccaggcggggtggctgt

SEQ ID NO: 10045088 - DNA, 22 bp, Homo sapiens
tggcacatagcaggtactcagt

SEQ ID NO: 10045089 - DNA, 22 bp, Homo sapiens
tggcacatagaaaaggatcaat

SEQ ID NO: 10045090 - DNA, 22 bp, Homo sapiens
tggcacatagtaggtgctcaat

SEQ ID NO: 10045091 - DNA, 22 bp, Homo sapiens
tggcacatggtaagtgcttaac

SEQ ID NO: 10045092 - DNA, 22 bp, Homo sapiens
tggcacatggtaagactcagta

SEQ ID NO: 10045093 - DNA, 22 bp, Homo sapiens
tggcacaaatctagtccctggt

SEQ ID NO: 10045094 - DNA, 22 bp, Homo sapiens
tggcaaactggaggaagccctg

SEQ ID NO: 10045095 - DNA, 22 bp, Homo sapiens
tggcaacacctggaagacatgg

SEQ ID NO: 10045096 - DNA, 22 bp, Homo sapiens
tggcaacatggacaggtctgcc

SEQ ID NO: 10045097 - DNA, 22 bp, Homo sapiens
tggcaacatgtcgaagtgctgt

SEQ ID NO: 10045098 - DNA, 22 bp, Homo sapiens
tggcgcaactcattcatggtgt

SEQ ID NO: 10045099 - DNA, 23 bp, Homo sapiens
tggctaaaggctctagtcctgct

SEQ ID NO: 10045100 - DNA, 22 bp, Homo sapiens
tggctcaagtgatcctcctgcc

SEQ ID NO: 10045101 - DNA, 22 bp, Homo sapiens
tggcttcttgggatgggtcatt

SEQ ID NO: 10045102 - DNA, 22 bp, Homo sapiens
tggctgtgtcatcatagctgtg

SEQ ID NO: 10045103 - DNA, 22 bp, Homo sapiens
tgctgtgaggttgagaaggaag

SEQ ID NO: 10045104 - DNA, 22 bp, Homo sapiens
tgctcctgtttcatcagctata

SEQ ID NO: 10045105 - DNA, 22 bp, Homo sapiens
tgctattacctgctggacagtc

SEQ ID NO: 10045106 - DNA, 22 bp, Homo sapiens
tgctattaatgaggctgcattt

SEQ ID NO: 10045107 - DNA, 22 bp, Homo sapiens
tgctattagaagccatgctgtt

SEQ ID NO: 10045108 - DNA, 22 bp, Homo sapiens
tgctattattgtcaccactgta

SEQ ID NO: 10045109 - DNA, 21 bp, Homo sapiens
tggaccaaagtaatttgcctt

SEQ ID NO: 10045110 - DNA, 22 bp, Homo sapiens
tggacaaatgatttctaccttt

SEQ ID NO: 10045111 - DNA, 22 bp, Homo sapiens
tggaatgacagagagtctgaat

SEQ ID NO: 10045112 - DNA, 22 bp, Homo sapiens
tggaagggagtgacagtcagag

SEQ ID NO: 10045113 - DNA, 17 bp, Homo sapiens
tggaagcttcatgttgg

SEQ ID NO: 10045114 - DNA, 22 bp, Homo sapiens
tgcttctggaaacagtggctgt

SEQ ID NO: 10045115 - DNA, 22 bp, Homo sapiens
tgcttctgggcaaatgtgtgtg

SEQ ID NO: 10045116 - DNA, 22 bp, Homo sapiens
tggaaacactcaagcttatatt

SEQ ID NO: 10045117 - DNA, 23 bp, Homo sapiens
tggaggttttactgagttgagga

SEQ ID NO: 10045118 - DNA, 22 bp, Homo sapiens
tggagctggggtttgaatctgg

SEQ ID NO: 10045119 - DNA, 22 bp, Homo sapiens
tggagccagagcgcagcctggg

SEQ ID NO: 10045120 - DNA, 22 bp, Homo sapiens
tggtcaggggcttctgagctgt

SEQ ID NO: 10045121 - DNA, 22 bp, Homo sapiens
tggtccaagtgaggtggcctct

SEQ ID NO: 10045122 - DNA, 22 bp, Homo sapiens
tggtctaaatatggctctaaat

SEQ ID NO: 10045123 - DNA, 19 bp, Homo sapiens
tggtctaaatgtgtgcccc

SEQ ID NO: 10045124 - DNA, 22 bp, Homo sapiens
tggtttctgccctcagagctca

SEQ ID NO: 10045125 - DNA, 22 bp, Homo sapiens
tggtttctgggtttgtctagga

SEQ ID NO: 10045126 - DNA, 22 bp, Homo sapiens
tggtttctcagactctttgcag

SEQ ID NO: 10045127 - DNA, 22 bp, Homo sapiens
tggtttctctgaactctacgac

SEQ ID NO: 10045128 - DNA, 22 bp, Homo sapiens
tggtggttatgcgctttgtggg

SEQ ID NO: 10045129 - DNA, 22 bp, Homo sapiens
tggtggtctggctttatatcct

SEQ ID NO: 10045130 - DNA, 22 bp, Homo sapiens
tggtttctttccactctccacc

SEQ ID NO: 10045131 - DNA, 22 bp, Homo sapiens
tgtaaataatgcatgtaaatca

SEQ ID NO: 10045132 - DNA, 22 bp, Homo sapiens
tgtaaataatgcatgtaaatca

SEQ ID NO: 10045133 - DNA, 22 bp, Homo sapiens
tgtacacaacctacagtctgct

SEQ ID NO: 10045134 - DNA, 18 bp, Homo sapiens
tgtccctgcaaataacat

SEQ ID NO: 10045135 - DNA, 22 bp, Homo sapiens
tgtatttttagacctttagacc

SEQ ID NO: 10045136 - DNA, 22 bp, Homo sapiens
tgtcacagtctcgtgagcatct

SEQ ID NO: 10045137 - DNA, 21 bp, Homo sapiens
tgtcacagattctcagcttgc

SEQ ID NO: 10045138 - DNA, 22 bp, Homo sapiens
tgtcacagatcgtttttgagct

SEQ ID NO: 10045139 - DNA, 22 bp, Homo sapiens
tggggctcacctaggctggaag

SEQ ID NO: 10045140 - DNA, 22 bp, Homo sapiens
tggggctcctcctggcaggagg

SEQ ID NO: 10045141 - DNA, 22 bp, Homo sapiens
tggtaaatatgtccattctctt

SEQ ID NO: 10045142 - DNA, 22 bp, Homo sapiens
tgggttctttcacttctcagtt

SEQ ID NO: 10045143 - DNA, 22 bp, Homo sapiens
tggtcaaatttagtctctggaa

SEQ ID NO: 10045144 - DNA, 22 bp, Homo sapiens
tggtcaaaagaaagctcagaac

SEQ ID NO: 10045145 - DNA, 22 bp, Homo sapiens
tggtcaaaaactctcagtggac

SEQ ID NO: 10045146 - DNA, 22 bp, Homo sapiens
tggtcaaaaaggcctagacaca

SEQ ID NO: 10045147 - DNA, 22 bp, Homo sapiens
tggtcaacaggcagggatgaaa

SEQ ID NO: 10045148 - DNA, 22 bp, Homo sapiens
tgggtggtccaggctcagcaga

SEQ ID NO: 10045149 - DNA, 22 bp, Homo sapiens
ttaataaagtatgaattggaaa

SEQ ID NO: 10045150 - DNA, 22 bp, Homo sapiens
ttattcaggctctctttggcta

SEQ ID NO: 10045151 - DNA, 22 bp, Homo sapiens
ttattcagtgcatatattaaaa

SEQ ID NO: 10045152 - DNA, 22 bp, Homo sapiens
ttattcattaacagggaccaaa

SEQ ID NO: 10045153 - DNA, 22 bp, Homo sapiens
ttagtgattactacatagatga

SEQ ID NO: 10045154 - DNA, 22 bp, Homo sapiens
ttagtgataggaagccagattg

SEQ ID NO: 10045155 - DNA, 22 bp, Homo sapiens
ttagtcaatagtgaatatagag

SEQ ID NO: 10045156 - DNA, 22 bp, Homo sapiens
ttagtaggagagcttgttcatt

SEQ ID NO: 10045157 - DNA, 19 bp, Homo sapiens
ttatgaatagcttcatcca

SEQ ID NO: 10045158 - DNA, 22 bp, Homo sapiens
ttagaaaggttttgctctgaaa

SEQ ID NO: 10045159 - DNA, 22 bp, Homo sapiens
ttagaaatgtcacagatctgat

SEQ ID NO: 10045160 - DNA, 22 bp, Homo sapiens
ttagggagctcagtcctcagat

SEQ ID NO: 10045161 - DNA, 22 bp, Homo sapiens
ttagatcattttgaactaattt

SEQ ID NO: 10045162 - DNA, 22 bp, Homo sapiens
ttcaccttgaatatgtcttaaa

SEQ ID NO: 10045163 - DNA, 22 bp, Homo sapiens
ttatttggttgctgacttggaa

SEQ ID NO: 10045164 - DNA, 22 bp, Homo sapiens
ttatttgggtttgagtgtggca

SEQ ID NO: 10045165 - DNA, 23 bp, Homo sapiens
ttatttggattttagtggaaaga

SEQ ID NO: 10045166 - DNA, 22 bp, Homo sapiens
ttatttggaaatatggcttctg

SEQ ID NO: 10045167 - DNA, 22 bp, Homo sapiens
ttcacattggtgatatgtttct

SEQ ID NO: 10045168 - DNA, 22 bp, Homo sapiens
ttcattagttctgaagatgtct

SEQ ID NO: 10045169 - DNA, 20 bp, Homo sapiens
ttcattcacgtagctgttga

SEQ ID NO: 10045170 - DNA, 22 bp, Homo sapiens
ttcattcatgtattgtctatgg

SEQ ID NO: 10045171 - DNA, 22 bp, Homo sapiens
tgtctctgaggtgagggtcagc

SEQ ID NO: 10045172 - DNA, 22 bp, Homo sapiens
tgtctctgataagtagttcagt

SEQ ID NO: 10045173 - DNA, 22 bp, Homo sapiens
tgtctccaggggcaggccagcc

SEQ ID NO: 10045174 - DNA, 22 bp, Homo sapiens
tgtctccaaaacaatctcagat

SEQ ID NO: 10045175 - DNA, 23 bp, Homo sapiens
tgtctggctcatggtgggtctca

SEQ ID NO: 10045176 - DNA, 22 bp, Homo sapiens
tgtttattacagttcttggaat

SEQ ID NO: 10045177 - DNA, 22 bp, Homo sapiens
tgtttattttcaggatggattg

SEQ ID NO: 10045178 - DNA, 18 bp, Homo sapiens
tgttaggaagggcacaca

SEQ ID NO: 10045179 - DNA, 22 bp, Homo sapiens
tgttttaatctcccattgctct

SEQ ID NO: 10045180 - DNA, 22 bp, Homo sapiens
tgcaccttcattttaggcagct

SEQ ID NO: 10045181 - DNA, 22 bp, Homo sapiens
tgcaccttgtccatttttggcc

SEQ ID NO: 10045182 - DNA, 22 bp, Homo sapiens
tgcaccttgttgcttttacgaa

SEQ ID NO: 10045183 - DNA, 22 bp, Homo sapiens
tgatgaataaacttgagagtca

SEQ ID NO: 10045184 - DNA, 22 bp, Homo sapiens
tgagtgctttaaatgttatttt

SEQ ID NO: 10045185 - DNA, 22 bp, Homo sapiens
tgatttttagctattctgaaga

SEQ ID NO: 10045186 - DNA, 19 bp, Homo sapiens
tgcataaattatatacttt

SEQ ID NO: 10045187 - DNA, 22 bp, Homo sapiens
tgcataaagtgccatagtatta

SEQ ID NO: 10045188 - DNA, 22 bp, Homo sapiens
tgcctccctggcaagtctctcc

SEQ ID NO: 10045189 - DNA, 22 bp, Homo sapiens
tgcccaaacctctcctagctct

SEQ ID NO: 10045190 - DNA, 22 bp, Homo sapiens
tcttttatcctacatttagctc

SEQ ID NO: 10045191 - DNA, 22 bp, Homo sapiens
tgaataaactatgaggaggaat

SEQ ID NO: 10045192 - DNA, 22 bp, Homo sapiens
tgaataagaattattataatga

SEQ ID NO: 10045193 - DNA, 21 bp, Homo sapiens
tgaatgaggaggatggcattt

SEQ ID NO: 10045194 - DNA, 22 bp, Homo sapiens
tgaattcttaatgaaatctact

SEQ ID NO: 10045195 - DNA, 19 bp, Homo sapiens
tgaggggctcacagtctca

SEQ ID NO: 10045196 - DNA, 22 bp, Homo sapiens
tgagtaataaactgtcttgctc

SEQ ID NO: 10045197 - DNA, 22 bp, Homo sapiens
tgagtatcaattacatagttgt

SEQ ID NO: 10045198 - DNA, 19 bp, Homo sapiens
tgaggccaaggtcacagat

SEQ ID NO: 10045199 - DNA, 22 bp, Homo sapiens
tgaggccagcttcagcagtgga

SEQ ID NO: 10045200 - DNA, 22 bp, Homo sapiens
tgagccaaacttctccttggtc

SEQ ID NO: 10045201 - DNA, 22 bp, Homo sapiens
tgagaggtaggaaatgaacaag

SEQ ID NO: 10045202 - DNA, 20 bp, Homo sapiens
tgagaagctcctgtctcctc

SEQ ID NO: 10045203 - DNA, 22 bp, Homo sapiens
tcctggccctctgcaaacgcca

SEQ ID NO: 10045204 - DNA, 22 bp, Homo sapiens
tcctggccctgtggcctgcagt

SEQ ID NO: 10045205 - DNA, 22 bp, Homo sapiens
tcctggccgccgcgtggggccg

SEQ ID NO: 10045206 - DNA, 22 bp, Homo sapiens
tcctggcctcacagtcctgggt

SEQ ID NO: 10045207 - DNA, 22 bp, Homo sapiens
tcctggcctagctcaccctgga

SEQ ID NO: 10045208 - DNA, 22 bp, Homo sapiens
tcctggccgctggcccctgaga

SEQ ID NO: 10045209 - DNA, 22 bp, Homo sapiens
tcctggcccggccgggcctgct

SEQ ID NO: 10045210 - DNA, 22 bp, Homo sapiens
tcctggcccgatccctgtgaag

SEQ ID NO: 10045211 - DNA, 22 bp, Homo sapiens
tcctggcccactatgccagcat

SEQ ID NO: 10045212 - DNA, 21 bp, Homo sapiens
tcctggcccactctatcccca

SEQ ID NO: 10045213 - DNA, 22 bp, Homo sapiens
tcctggcctccgttctctgcat

SEQ ID NO: 10045214 - DNA, 20 bp, Homo sapiens
tcctggcctccctggggctc

SEQ ID NO: 10045215 - DNA, 22 bp, Homo sapiens
tcctggcctcgctgtccacctt

SEQ ID NO: 10045216 - DNA, 22 bp, Homo sapiens
tcctggccaagttactctctgc

SEQ ID NO: 10045217 - DNA, 18 bp, Homo sapiens
tcctggccacactacctt

SEQ ID NO: 10045218 - DNA, 22 bp, Homo sapiens
tcctggccagaggacaaagctg

SEQ ID NO: 10045219 - DNA, 22 bp, Homo sapiens
tcctggccaggatgacctaaca

SEQ ID NO: 10045220 - DNA, 22 bp, Homo sapiens
tcctggcccaatctgcccatga

SEQ ID NO: 10045221 - DNA, 21 bp, Homo sapiens
tcctggccagggcactaggca

SEQ ID NO: 10045222 - DNA, 22 bp, Homo sapiens
tcctgtgcctccacctgctccg

SEQ ID NO: 10045223 - DNA, 22 bp, Homo sapiens
tcctgggcggttatgtgatctg

SEQ ID NO: 10045224 - DNA, 19 bp, Homo sapiens
tcctgggctgcgtcttgcc

SEQ ID NO: 10045225 - DNA, 22 bp, Homo sapiens
tcctgggcaaaagtatctgtga

SEQ ID NO: 10045226 - DNA, 22 bp, Homo sapiens
tctactgtggtccttgtaacca

SEQ ID NO: 10045227 - DNA, 22 bp, Homo sapiens
tctactgtagtgatgctgcagt

SEQ ID NO: 10045228 - DNA, 22 bp, Homo sapiens
tctactgcactggtgtctcatc

SEQ ID NO: 10045229 - DNA, 22 bp, Homo sapiens
tctaacattgtttttcacagat

SEQ ID NO: 10045230 - DNA, 22 bp, Homo sapiens
tctcacagcaggggccaggtct

SEQ ID NO: 10045231 - DNA, 22 bp, Homo sapiens
tctcacagcatcattgctcatg

SEQ ID NO: 10045232 - DNA, 22 bp, Homo sapiens
tctatttaccaaatgtagttcc

SEQ ID NO: 10045233 - DNA, 22 bp, Homo sapiens
tctattcattcaatttagctct

SEQ ID NO: 10045234 - DNA, 22 bp, Homo sapiens
tctcaaatatttggagagagga

SEQ ID NO: 10045235 - DNA, 22 bp, Homo sapiens
tctataaatgcagatatgtgtg

SEQ ID NO: 10045236 - DNA, 22 bp, Homo sapiens
tccttgactgtgaggaactagc

SEQ ID NO: 10045237 - DNA, 22 bp, Homo sapiens
tctctcaggctggagtgcagtg

SEQ ID NO: 10045238 - DNA, 22 bp, Homo sapiens
tctctcagaggaagaggcagtg

SEQ ID NO: 10045239 - DNA, 22 bp, Homo sapiens
tctctggccgagagtccctggg

SEQ ID NO: 10045240 - DNA, 22 bp, Homo sapiens
tctctggcagggatatctggct

SEQ ID NO: 10045241 - DNA, 19 bp, Homo sapiens
tctctgcttctcttggcat

SEQ ID NO: 10045242 - DNA, 21 bp, Homo sapiens
tctctgtgtctttaagctgga

SEQ ID NO: 10045243 - DNA, 22 bp, Homo sapiens
tctctggttattaactaactcc

SEQ ID NO: 10045244 - DNA, 22 bp, Homo sapiens
tctgaagcctttgtacaggcct

SEQ ID NO: 10045245 - DNA, 17 bp, Homo sapiens
tctgaagccagtctgct

SEQ ID NO: 10045246 - DNA, 22 bp, Homo sapiens
tctgaagccacctctgcttgtc

SEQ ID NO: 10045247 - DNA, 22 bp, Homo sapiens
tctgaaggtgctagagaaagct

SEQ ID NO: 10045248 - DNA, 22 bp, Homo sapiens
tctcattggtatatacatgtgt

SEQ ID NO: 10045249 - DNA, 22 bp, Homo sapiens
tctcagtctttgcaaggatgct

SEQ ID NO: 10045250 - DNA, 22 bp, Homo sapiens
tctcagtcagccttgatgtccc

SEQ ID NO: 10045251 - DNA, 22 bp, Homo sapiens
tctcagagtttagagctgagcc

SEQ ID NO: 10045252 - DNA, 22 bp, Homo sapiens
tctcagagggaaacatgagtga

SEQ ID NO: 10045253 - DNA, 22 bp, Homo sapiens
tctcagagagatgaaacttcca

SEQ ID NO: 10045254 - DNA, 22 bp, Homo sapiens
tctcactttccagacttttcaa

SEQ ID NO: 10045255 - DNA, 22 bp, Homo sapiens
tctcactgggtataaatgagta

SEQ ID NO: 10045256 - DNA, 22 bp, Homo sapiens
tctcactgcaaatattatgtat

SEQ ID NO: 10045257 - DNA, 22 bp, Homo sapiens
tctcacagtgagcctgaggtcg

SEQ ID NO: 10045258 - DNA, 22 bp, Homo sapiens
tctcgctctgtcgcccaggctg

SEQ ID NO: 10045259 - DNA, 22 bp, Homo sapiens
tctcctggtttgttaaataatt

SEQ ID NO: 10045260 - DNA, 20 bp, Homo sapiens
tctcctggtctggtccgtgc

SEQ ID NO: 10045261 - DNA, 20 bp, Homo sapiens
tctcctggtgacagtaccca

SEQ ID NO: 10045262 - DNA, 22 bp, Homo sapiens
tctcctggtcacctcagaagtc

SEQ ID NO: 10045263 - DNA, 22 bp, Homo sapiens
tctcctggtacccttcctagca

SEQ ID NO: 10045264 - DNA, 22 bp, Homo sapiens
tctcctggtatgtatgcacctg

SEQ ID NO: 10045265 - DNA, 22 bp, Homo sapiens
tctcctgggtgctttatcagaa

SEQ ID NO: 10045266 - DNA, 22 bp, Homo sapiens
tctcctggtacccttcctagca

SEQ ID NO: 10045267 - DNA, 21 bp, Homo sapiens
tctcctgggtccaacccatgc

SEQ ID NO: 10045268 - DNA, 18 bp, Homo sapiens
tctcctgggtaggggcct

SEQ ID NO: 10045269 - DNA, 22 bp, Homo sapiens
tctcctgggtaaaagggttgat

SEQ ID NO: 10045270 - DNA, 22 bp, Homo sapiens
tctcctgggcttggttgaagtt

SEQ ID NO: 10045271 - DNA, 22 bp, Homo sapiens
tctcctggccctgtcgccatct

SEQ ID NO: 10045272 - DNA, 22 bp, Homo sapiens
tctcctccttttttcaacatag

SEQ ID NO: 10045273 - DNA, 23 bp, Homo sapiens
tctcctcctagatacagtcatgg

SEQ ID NO: 10045274 - DNA, 22 bp, Homo sapiens
tctcctctcttacctggtacaa

SEQ ID NO: 10045275 - DNA, 22 bp, Homo sapiens
tctcctctatttctgtatgtat

SEQ ID NO: 10045276 - DNA, 22 bp, Homo sapiens
tctcctggaagaataccacact

SEQ ID NO: 10045277 - DNA, 22 bp, Homo sapiens
tctcctggaagtgattcccctg

SEQ ID NO: 10045278 - DNA, 22 bp, Homo sapiens
tctcctggatagatactatcca

SEQ ID NO: 10045279 - DNA, 22 bp, Homo sapiens
tctcctggatggaccttctctt

SEQ ID NO: 10045280 - DNA, 22 bp, Homo sapiens
tctcctggcatttggttgagta

SEQ ID NO: 10045281 - DNA, 22 bp, Homo sapiens
tctcctggcatgtgggtcatct

SEQ ID NO: 10045282 - DNA, 22 bp, Homo sapiens
tctcctggagcccagatgctgg

SEQ ID NO: 10045283 - DNA, 22 bp, Homo sapiens
tctcctggagcaggaaggtggg

SEQ ID NO: 10045284 - DNA, 22 bp, Homo sapiens
tctggccatggcaagccgagtg

SEQ ID NO: 10045285 - DNA, 22 bp, Homo sapiens
tctggccaggatggcaagacca

SEQ ID NO: 10045286 - DNA, 22 bp, Homo sapiens
tctggccagtgaaatgcagaat

SEQ ID NO: 10045287 - DNA, 22 bp, Homo sapiens
tctggccaggggtccctgaagg

SEQ ID NO: 10045288 - DNA, 22 bp, Homo sapiens
tctggccagtagatgtgggttg

SEQ ID NO: 10045289 - DNA, 22 bp, Homo sapiens
tctggccactaataggtctcac

SEQ ID NO: 10045290 - DNA, 22 bp, Homo sapiens
tctggccacttgcttcacactg

SEQ ID NO: 10045291 - DNA, 22 bp, Homo sapiens
tctggccagaaagacttgatgt

SEQ ID NO: 10045292 - DNA, 22 bp, Homo sapiens
tctggccagcatgagacctggt

SEQ ID NO: 10045293 - DNA, 22 bp, Homo sapiens
tctggccacccgaggcccctgc

SEQ ID NO: 10045294 - DNA, 22 bp, Homo sapiens
tctggccaatgttgtgatcaca

SEQ ID NO: 10045295 - DNA, 22 bp, Homo sapiens
tctggccaacaaaaactaagtc

SEQ ID NO: 10045296 - DNA, 22 bp, Homo sapiens
tctggccaaccctcaagttgta

SEQ ID NO: 10045297 - DNA, 22 bp, Homo sapiens
tctggcaaaggcaaccacagtt

SEQ ID NO: 10045298 - DNA, 23 bp, Homo sapiens
tctgggccacttgtctgcacttc

SEQ ID NO: 10045299 - DNA, 22 bp, Homo sapiens
tctgggataagaccacagattt

SEQ ID NO: 10045300 - DNA, 22 bp, Homo sapiens
tctggctttcatttgtttaaag

SEQ ID NO: 10045301 - DNA, 22 bp, Homo sapiens
tctgcatcatttttcagagccg

SEQ ID NO: 10045302 - DNA, 22 bp, Homo sapiens
tctgagcctatttcaaattcct

SEQ ID NO: 10045303 - DNA, 22 bp, Homo sapiens
tctgagccgtatggcttggcta

SEQ ID NO: 10045304 - DNA, 22 bp, Homo sapiens
tctgagccctcttttgcagccc

SEQ ID NO: 10045305 - DNA, 22 bp, Homo sapiens
tctgagccagggtctcctccct

SEQ ID NO: 10045306 - DNA, 22 bp, Homo sapiens
tctgagccacctgccagtgctg

SEQ ID NO: 10045307 - DNA, 22 bp, Homo sapiens
tctgagccagccacctccttca

SEQ ID NO: 10045308 - DNA, 22 bp, Homo sapiens
tctgagccacagatgtcctgtt

SEQ ID NO: 10045309 - DNA, 22 bp, Homo sapiens
tctgagccaatttctgtgtcca

SEQ ID NO: 10045310 - DNA, 22 bp, Homo sapiens
tctgagccaaaataaacagcat

SEQ ID NO: 10045311 - DNA, 22 bp, Homo sapiens
tctgtgccacctctccagtgtc

SEQ ID NO: 10045312 - DNA, 22 bp, Homo sapiens
tctgtgcctccgtaacacacca

SEQ ID NO: 10045313 - DNA, 22 bp, Homo sapiens
tctgtgcctcatctggttcagg

SEQ ID NO: 10045314 - DNA, 22 bp, Homo sapiens
tcttcattccgtagatatttat

SEQ ID NO: 10045315 - DNA, 22 bp, Homo sapiens
tcttcattttatagcatctgtg

SEQ ID NO: 10045316 - DNA, 22 bp, Homo sapiens
tcttgctaaagaccaacacatt

SEQ ID NO: 10045317 - DNA, 22 bp, Homo sapiens
tcttggccaggtgtggtgcctc

SEQ ID NO: 10045318 - DNA, 22 bp, Homo sapiens
tcttggccccacctgtgccagc

SEQ ID NO: 10045319 - DNA, 21 bp, Homo sapiens
tcttggcctaagttcactgaa

SEQ ID NO: 10045320 - DNA, 22 bp, Homo sapiens
tcttggcaatttgatctcagtt

SEQ ID NO: 10045321 - DNA, 18 bp, Homo sapiens
tcttggcagcatctggca

SEQ ID NO: 10045322 - DNA, 19 bp, Homo sapiens
tctttcatttctagctctg

SEQ ID NO: 10045323 - DNA, 22 bp, Homo sapiens
aagaggtagcagtcacaaaaga

SEQ ID NO: 10045324 - DNA, 22 bp, Homo sapiens
acacatttctctttttgtaagt

SEQ ID NO: 10045325 - DNA, 22 bp, Homo sapiens
acacctttcaggtccagacagt

SEQ ID NO: 10045326 - DNA, 22 bp, Homo sapiens
acacctttgccccaagtcatag

SEQ ID NO: 10045327 - DNA, 22 bp, Homo sapiens
acacctttgtgaagtgatgatg

SEQ ID NO: 10045328 - DNA, 22 bp, Homo sapiens
acaccttttattcgccaggcac

SEQ ID NO: 10045329 - DNA, 20 bp, Homo sapiens
aagagtctttactgagctaa

SEQ ID NO: 10045330 - DNA, 22 bp, Homo sapiens
aagagtctattggaactagaca

SEQ ID NO: 10045331 - DNA, 22 bp, Homo sapiens
aatgtgaaaccgcacagaataa

SEQ ID NO: 10045332 - DNA, 22 bp, Homo sapiens
aactctggagcacgccctggcc

SEQ ID NO: 10045333 - DNA, 22 bp, Homo sapiens
aactcctgttctatgacaagag

SEQ ID NO: 10045334 - DNA, 22 bp, Homo sapiens
aactcctgaggaaatggtctca

SEQ ID NO: 10045335 - DNA, 23 bp, Homo sapiens
aactcctgaatcgtgagccatct

SEQ ID NO: 10045336 - DNA, 22 bp, Homo sapiens
acaactccttcttgggtcctgg

SEQ ID NO: 10045337 - DNA, 20 bp, Homo sapiens
aattagatgtttaatcaata

SEQ ID NO: 10045338 - DNA, 22 bp, Homo sapiens
aattagaagctgttagcaaaat

SEQ ID NO: 10045339 - DNA, 22 bp, Homo sapiens
aattagaagggagttattgata

SEQ ID NO: 10045340 - DNA, 22 bp, Homo sapiens
aattagaatcttatttggggaa

SEQ ID NO: 10045341 - DNA, 22 bp, Homo sapiens
aaggagaaatggtagatgtgca

SEQ ID NO: 10045342 - DNA, 22 bp, Homo sapiens
aaggggaagtagcaccagaggt

SEQ ID NO: 10045343 - DNA, 22 bp, Homo sapiens
aatcacatttacattgctaatt

SEQ ID NO: 10045344 - DNA, 22 bp, Homo sapiens
aatcacattacagcatatctgt

SEQ ID NO: 10045345 - DNA, 20 bp, Homo sapiens
aactcctagcctcaagtgat

SEQ ID NO: 10045346 - DNA, 22 bp, Homo sapiens
aactccagtgtcagctgcaatg

SEQ ID NO: 10045347 - DNA, 22 bp, Homo sapiens
aactccagggcattgtctcctg

SEQ ID NO: 10045348 - DNA, 22 bp, Homo sapiens
aactcagttacatattagaata

SEQ ID NO: 10045349 - DNA, 20 bp, Homo sapiens
aataaactactgagagatgt

SEQ ID NO: 10045350 - DNA, 22 bp, Homo sapiens
aaacatttgcaactcggtttgg

SEQ ID NO: 10045351 - DNA, 22 bp, Homo sapiens
aaactactatgggaatgtactt

SEQ ID NO: 10045352 - DNA, 22 bp, Homo sapiens
aaatactgttgaatgaagtaag

SEQ ID NO: 10045353 - DNA, 22 bp, Homo sapiens
aaatattattgcttaaggggag

SEQ ID NO: 10045354 - DNA, 22 bp, Homo sapiens
aagacactgatactctgtgatt

SEQ ID NO: 10045355 - DNA, 22 bp, Homo sapiens
aactcactttgtggcttctgaa

SEQ ID NO: 10045356 - DNA, 22 bp, Homo sapiens
aacagctttgagcagttctgta

SEQ ID NO: 10045357 - DNA, 22 bp, Homo sapiens
aacagcttgctgcaccttaata

SEQ ID NO: 10045358 - DNA, 22 bp, Homo sapiens
aacagctttagaggataatagt

SEQ ID NO: 10045359 - DNA, 22 bp, Homo sapiens
aacagctttgtgctcagatttg

SEQ ID NO: 10045360 - DNA, 22 bp, Homo sapiens
aacagcttttttggtcagcatt

SEQ ID NO: 10045361 - DNA, 22 bp, Homo sapiens
aacagctttgtatacagtaact

SEQ ID NO: 10045362 - DNA, 22 bp, Homo sapiens
aacagctttgcttctggagaca

SEQ ID NO: 10045363 - DNA, 22 bp, Homo sapiens
aattcatactctatattgcttt

SEQ ID NO: 10045364 - DNA, 22 bp, Homo sapiens
aatgtataaagtgttaataact

SEQ ID NO: 10045365 - DNA, 23 bp, Homo sapiens
agagagagtttgtgtcaggtacc

SEQ ID NO: 10045366 - DNA, 22 bp, Homo sapiens
agacactgccacttctgttccc

SEQ ID NO: 10045367 - DNA, 22 bp, Homo sapiens
agacactgatgttcagctcaat

SEQ ID NO: 10045368 - DNA, 22 bp, Homo sapiens
agacactgagcattttcctagc

SEQ ID NO: 10045369 - DNA, 22 bp, Homo sapiens
agacactgaatgtttggtggtc

SEQ ID NO: 10045370 - DNA, 22 bp, Homo sapiens
agacactgaaatgtattgaaga

SEQ ID NO: 10045371 - DNA, 22 bp, Homo sapiens
agacactggcactggggaagcc

SEQ ID NO: 10045372 - DNA, 21 bp, Homo sapiens
acaggctttagaaaatgactc

SEQ ID NO: 10045373 - DNA, 20 bp, Homo sapiens
acagatgaggaaaatgaagt

SEQ ID NO: 10045374 - DNA, 22 bp, Homo sapiens
acataagtgcacaataaatatt

SEQ ID NO: 10045375 - DNA, 22 bp, Homo sapiens
acattcaacatggctggtctag

SEQ ID NO: 10045376 - DNA, 22 bp, Homo sapiens
aataaagacaaacaggggagcc

SEQ ID NO: 10045377 - DNA, 21 bp, Homo sapiens
aagtaaatcagagaaataacc

SEQ ID NO: 10045378 - DNA, 22 bp, Homo sapiens
aagtaaatatctgtttatagca

SEQ ID NO: 10045379 - DNA, 22 bp, Homo sapiens
aagtgaatttcattccaattct

SEQ ID NO: 10045380 - DNA, 22 bp, Homo sapiens
accttgttaaaatgaggattct

SEQ ID NO: 10045381 - DNA, 22 bp, Homo sapiens
acttcctgcaatcgtccactcc

SEQ ID NO: 10045382 - DNA, 19 bp, Homo sapiens
acttcctgcccgctccttt

SEQ ID NO: 10045383 - DNA, 22 bp, Homo sapiens
acttcctgaatggggctaatta

SEQ ID NO: 10045384 - DNA, 17 bp, Homo sapiens
acttcccacccctccag

SEQ ID NO: 10045385 - DNA, 22 bp, Homo sapiens
acttattctgagattatgatca

SEQ ID NO: 10045386 - DNA, 22 bp, Homo sapiens
acttataagagtgctatgggga

SEQ ID NO: 10045387 - DNA, 22 bp, Homo sapiens
aatctgttctactctattcaga

SEQ ID NO: 10045388 - DNA, 17 bp, Homo sapiens
aatctgtttacagtcag

SEQ ID NO: 10045389 - DNA, 22 bp, Homo sapiens
aatctgtttagttctgcgtatg

SEQ ID NO: 10045390 - DNA, 22 bp, Homo sapiens
aatatgcattaactgtgtacat

SEQ ID NO: 10045391 - DNA, 22 bp, Homo sapiens
aatatgttccacttaaagctgg

SEQ ID NO: 10045392 - DNA, 22 bp, Homo sapiens
aatattaatagaaggggttcta

SEQ ID NO: 10045393 - DNA, 22 bp, Homo sapiens
agcatgcgcttgatcagctcca

SEQ ID NO: 10045394 - DNA, 22 bp, Homo sapiens
caccagagttgtccaaatgatt

SEQ ID NO: 10045395 - DNA, 22 bp, Homo sapiens
cacatttaatcctttataagta

SEQ ID NO: 10045396 - DNA, 22 bp, Homo sapiens
cagagacccttctcagtggcca

SEQ ID NO: 10045397 - DNA, 19 bp, Homo sapiens
agccagcagcgtagcatct

SEQ ID NO: 10045398 - DNA, 22 bp, Homo sapiens
agccagcaggaacgtctaggtt

SEQ ID NO: 10045399 - DNA, 22 bp, Homo sapiens
agccagcagggcttagaggaca

SEQ ID NO: 10045400 - DNA, 22 bp, Homo sapiens
cagagctctatgttcatggagg

SEQ ID NO: 10045401 - DNA, 22 bp, Homo sapiens
cagatgaagatcatagaatagt

SEQ ID NO: 10045402 - DNA, 22 bp, Homo sapiens
agagcactgctgatttacagtc

SEQ ID NO: 10045403 - DNA, 22 bp, Homo sapiens
agactttaatgtgcaaatgaaa

SEQ ID NO: 10045404 - DNA, 22 bp, Homo sapiens
atgcatattgattatagattca

SEQ ID NO: 10045405 - DNA, 19 bp, Homo sapiens
atctgcctgttatcacata

SEQ ID NO: 10045406 - DNA, 22 bp, Homo sapiens
atctgcctggctccaggtgagc

SEQ ID NO: 10045407 - DNA, 22 bp, Homo sapiens
atctgcctccaagtccatgtgt

SEQ ID NO: 10045408 - DNA, 22 bp, Homo sapiens
atctgcctcttcttcattgcga

SEQ ID NO: 10045409 - DNA, 22 bp, Homo sapiens
atctgcctgcagtggaggtggg

SEQ ID NO: 10045410 - DNA, 22 bp, Homo sapiens
atctgcctgagtctaggttttc

SEQ ID NO: 10045411 - DNA, 19 bp, Homo sapiens
atctgccttagtgctgctg

SEQ ID NO: 10045412 - DNA, 23 bp, Homo sapiens
agacactgtaaagaattgcagtt

SEQ ID NO: 10045413 - DNA, 22 bp, Homo sapiens
agatattaatcgtacataaggt

SEQ ID NO: 10045414 - DNA, 22 bp, Homo sapiens
agatattaggaggattcataat

SEQ ID NO: 10045415 - DNA, 22 bp, Homo sapiens
acccagagcacagatgcaacgt

SEQ ID NO: 10045416 - DNA, 22 bp, Homo sapiens
acattctagatatgttatattt

SEQ ID NO: 10045417 - DNA, 22 bp, Homo sapiens
acattcaaggccttctgacaca

SEQ ID NO: 10045418 - DNA, 20 bp, Homo sapiens
acagccagaggaggcagaca

SEQ ID NO: 10045419 - DNA, 22 bp, Homo sapiens
aggaaactcccctacatctcaa

SEQ ID NO: 10045420 - DNA, 22 bp, Homo sapiens
atcagtcatatccaaattagca

SEQ ID NO: 10045421 - DNA, 22 bp, Homo sapiens
acttttggttctgtaactgtga

SEQ ID NO: 10045422 - DNA, 19 bp, Homo sapiens
atcccaaggagctgggact

SEQ ID NO: 10045423 - DNA, 20 bp, Homo sapiens
atagatatcatctttagaag

SEQ ID NO: 10045424 - DNA, 22 bp, Homo sapiens
atagagttttattttccaataa

SEQ ID NO: 10045425 - DNA, 22 bp, Homo sapiens
atagatacattgttatatttgt

SEQ ID NO: 10045426 - DNA, 19 bp, Homo sapiens
ataaataaaaagtgggaga

SEQ ID NO: 10045427 - DNA, 20 bp, Homo sapiens
agtgaatagagacattgccc

SEQ ID NO: 10045428 - DNA, 22 bp, Homo sapiens
agtgaaatttgtttagataggt

SEQ ID NO: 10045429 - DNA, 22 bp, Homo sapiens
actgcctgctcataacattgct

SEQ ID NO: 10045430 - DNA, 19 bp, Homo sapiens
actgcctgaggctcacagg

SEQ ID NO: 10045431 - DNA, 21 bp, Homo sapiens
actggccaccactggcagggg

SEQ ID NO: 10045432 - DNA, 22 bp, Homo sapiens
actgccattggtcaaatgagtg

SEQ ID NO: 10045433 - DNA, 21 bp, Homo sapiens
actccctgcataagtgattta

SEQ ID NO: 10045434 - DNA, 22 bp, Homo sapiens
actccagggttttgcacctgga

SEQ ID NO: 10045435 - DNA, 22 bp, Homo sapiens
actcctggaaaagaacgcaggg

SEQ ID NO: 10045436 - DNA, 22 bp, Homo sapiens
actcctggggatccattccttt

SEQ ID NO: 10045437 - DNA, 22 bp, Homo sapiens
actcctggggctgccatcacag

SEQ ID NO: 10045438 - DNA, 22 bp, Homo sapiens
actcctgggtgctgaccagcgt

SEQ ID NO: 10045439 - DNA, 22 bp, Homo sapiens
actcctgggtgcatttctgatt

SEQ ID NO: 10045440 - DNA, 22 bp, Homo sapiens
agtcactggttctgtaattaat

SEQ ID NO: 10045441 - DNA, 22 bp, Homo sapiens
agtcactgttctgtcatgtcaa

SEQ ID NO: 10045442 - DNA, 22 bp, Homo sapiens
agtcactgttctgtcatgtcaa

SEQ ID NO: 10045443 - DNA, 22 bp, Homo sapiens
agtcactgtttaatctagctaa

SEQ ID NO: 10045444 - DNA, 22 bp, Homo sapiens
actctctggtattggcaagttt

SEQ ID NO: 10045445 - DNA, 22 bp, Homo sapiens
agtaataatagctgtaaagtgc

SEQ ID NO: 10045446 - DNA, 22 bp, Homo sapiens
agtagtcagcagataatatagg

SEQ ID NO: 10045447 - DNA, 22 bp, Homo sapiens
actaaatatttgagaggtgtag

SEQ ID NO: 10045448 - DNA, 22 bp, Homo sapiens
accttttccagcttctagaggc

SEQ ID NO: 10045449 - DNA, 22 bp, Homo sapiens
acctttttgttctgttctcagc

SEQ ID NO: 10045450 - DNA, 22 bp, Homo sapiens
accttttatgtaaatatatgtt

SEQ ID NO: 10045451 - DNA, 22 bp, Homo sapiens
cctgtttacatcatcaaggact

SEQ ID NO: 10045452 - DNA, 22 bp, Homo sapiens
cctgtttagtgaggtgaggagt

SEQ ID NO: 10045453 - DNA, 22 bp, Homo sapiens
cctgtttatctatctagagatg

SEQ ID NO: 10045454 - DNA, 22 bp, Homo sapiens
ccttcattgcatctttaagaga

SEQ ID NO: 10045455 - DNA, 22 bp, Homo sapiens
cctgtgccagctgggccctgcc

SEQ ID NO: 10045456 - DNA, 22 bp, Homo sapiens
aggtcacccgtttgactatcca

SEQ ID NO: 10045457 - DNA, 22 bp, Homo sapiens
aggtcaccatggcatgctccac

SEQ ID NO: 10045458 - DNA, 22 bp, Homo sapiens
aggtcaccatggcatgctccac

SEQ ID NO: 10045459 - DNA, 22 bp, Homo sapiens
aggtaaaatagatagtatttct

SEQ ID NO: 10045460 - DNA, 22 bp, Homo sapiens
ctattgaattaactattaaagt

SEQ ID NO: 10045461 - DNA, 22 bp, Homo sapiens
ctattgaatagcccaaatcatt

SEQ ID NO: 10045462 - DNA, 22 bp, Homo sapiens
ctattgaaagtgtacaattcaa

SEQ ID NO: 10045463 - DNA, 22 bp, Homo sapiens
ctattctagattacagtataaa

SEQ ID NO: 10045464 - DNA, 22 bp, Homo sapiens
agtcacagaatgatggctccag

SEQ ID NO: 10045465 - DNA, 22 bp, Homo sapiens
agtcaattatctctaggtcatc

SEQ ID NO: 10045466 - DNA, 22 bp, Homo sapiens
agtcaattcttttcaactcaag

SEQ ID NO: 10045467 - DNA, 22 bp, Homo sapiens
agtcacagaaacccaggtgtgg

SEQ ID NO: 10045468 - DNA, 19 bp, Homo sapiens
agtcacagaccttgtctcc

SEQ ID NO: 10045469 - DNA, 22 bp, Homo sapiens
agtaaataacagagaaaatggg

SEQ ID NO: 10045470 - DNA, 22 bp, Homo sapiens
agtacagtggtcataatataaa

SEQ ID NO: 10045471 - DNA, 22 bp, Homo sapiens
agtggactcttcccagtgcttg

SEQ ID NO: 10045472 - DNA, 18 bp, Homo sapiens
agtcttctgatccatttt

SEQ ID NO: 10045473 - DNA, 22 bp, Homo sapiens
agtctcagaaaagaagcatgga

SEQ ID NO: 10045474 - DNA, 22 bp, Homo sapiens
agtgaaatgattctgagcaaga

SEQ ID NO: 10045475 - DNA, 22 bp, Homo sapiens
ctgagccaccggcagggacatc

SEQ ID NO: 10045476 - DNA, 22 bp, Homo sapiens
ctgagccagggccacacatgga

SEQ ID NO: 10045477 - DNA, 22 bp, Homo sapiens
ctgagccagcgggctcactttt

SEQ ID NO: 10045478 - DNA, 22 bp, Homo sapiens
ctgagccagctggcatgtgcta

SEQ ID NO: 10045479 - DNA, 22 bp, Homo sapiens
ctgagccagctggcatgtgcta

SEQ ID NO: 10045480 - DNA, 22 bp, Homo sapiens
atatacttgatttaactgagca

SEQ ID NO: 10045481 - DNA, 22 bp, Homo sapiens
ctggcgcaacagaaaatctgga

SEQ ID NO: 10045482 - DNA, 22 bp, Homo sapiens
ctggctcaatttgtactgctgt

SEQ ID NO: 10045483 - DNA, 22 bp, Homo sapiens
ctggcacaatgtcacttttgct

SEQ ID NO: 10045484 - DNA, 22 bp, Homo sapiens
ctggcacacaagtatttccttt

SEQ ID NO: 10045485 - DNA, 22 bp, Homo sapiens
ctggcacagccactgcaggcag

SEQ ID NO: 10045486 - DNA, 22 bp, Homo sapiens
ctggccactggtggtcataggc

SEQ ID NO: 10045487 - DNA, 21 bp, Homo sapiens
ctggccgacccctctgtgctc

SEQ ID NO: 10045488 - DNA, 22 bp, Homo sapiens
ctggcctagctctctgcttgaa

SEQ ID NO: 10045489 - DNA, 22 bp, Homo sapiens
ctggcctaaaattgcttctgca

SEQ ID NO: 10045490 - DNA, 22 bp, Homo sapiens
ctgcctgggttcaagtcctgtt

SEQ ID NO: 10045491 - DNA, 22 bp, Homo sapiens
agttctcagcttagtatgctgt

SEQ ID NO: 10045492 - DNA, 22 bp, Homo sapiens
atcataaagtgctatctgattg

SEQ ID NO: 10045493 - DNA, 22 bp, Homo sapiens
atcataaaattgcaccatttct

SEQ ID NO: 10045494 - DNA, 22 bp, Homo sapiens
ctggtccattctctccctgaag

SEQ ID NO: 10045495 - DNA, 18 bp, Homo sapiens
atattcaagaagacagag

SEQ ID NO: 10045496 - DNA, 22 bp, Homo sapiens
atattattttccctggagttgt

SEQ ID NO: 10045497 - DNA, 22 bp, Homo sapiens
cttattagagttgtgttctgtt

SEQ ID NO: 10045498 - DNA, 22 bp, Homo sapiens
cttattagtgtctgtctgagtt

SEQ ID NO: 10045499 - DNA, 19 bp, Homo sapiens
cttattagagtgagagctt

SEQ ID NO: 10045500 - DNA, 22 bp, Homo sapiens
cttattagaaagaaaagacatg

SEQ ID NO: 10045501 - DNA, 22 bp, Homo sapiens
cttctgcaataagttttggtcc

SEQ ID NO: 10045502 - DNA, 22 bp, Homo sapiens
aggaattgagatcctaggtttt

SEQ ID NO: 10045503 - DNA, 22 bp, Homo sapiens
aggaattatttgtcttagtctt

SEQ ID NO: 10045504 - DNA, 22 bp, Homo sapiens
catcagaggtacttaatgaatg

SEQ ID NO: 10045505 - DNA, 23 bp, Homo sapiens
catcagaggttgccactccctgg

SEQ ID NO: 10045506 - DNA, 22 bp, Homo sapiens
aggatcttgctgtagaggatag

SEQ ID NO: 10045507 - DNA, 22 bp, Homo sapiens
aggatagttgtgaagataggct

SEQ ID NO: 10045508 - DNA, 18 bp, Homo sapiens
aggatattaagagtacag

SEQ ID NO: 10045509 - DNA, 22 bp, Homo sapiens
aggatatttgcttaagatagct

SEQ ID NO: 10045510 - DNA, 22 bp, Homo sapiens
aggaatgaactcgagtgatctg

SEQ ID NO: 10045511 - DNA, 22 bp, Homo sapiens
ccaggctgggctacaagttgag

SEQ ID NO: 10045512 - DNA, 22 bp, Homo sapiens
cccatctcagtcgtgctaaggg

SEQ ID NO: 10045513 - DNA, 22 bp, Homo sapiens
cccatgagattctgaatttggc

SEQ ID NO: 10045514 - DNA, 22 bp, Homo sapiens
ccctcccaggagtggccagaga

SEQ ID NO: 10045515 - DNA, 22 bp, Homo sapiens
ccctcccaagcactctgacata

SEQ ID NO: 10045516 - DNA, 22 bp, Homo sapiens
gtcctctgttagaaatgtgctt

SEQ ID NO: 10045517 - DNA, 22 bp, Homo sapiens
gtgaataatcacccttctggat

SEQ ID NO: 10045518 - DNA, 22 bp, Homo sapiens
gtgaataactttctatgttaat

SEQ ID NO: 10045519 - DNA, 22 bp, Homo sapiens
cagagttcaaagcctgctggga

SEQ ID NO: 10045520 - DNA, 22 bp, Homo sapiens
gctggccagtgtggtgaccacc

SEQ ID NO: 10045521 - DNA, 22 bp, Homo sapiens
caaatttaggtaacagtctgta

SEQ ID NO: 10045522 - DNA, 22 bp, Homo sapiens
gctggccatatattttgctgtt

SEQ ID NO: 10045523 - DNA, 22 bp, Homo sapiens
gctggccatagaagccaaagag

SEQ ID NO: 10045524 - DNA, 22 bp, Homo sapiens
gctggccatggcctgcgccatc

SEQ ID NO: 10045525 - DNA, 22 bp, Homo sapiens
gctggccatggggagtgaggag

SEQ ID NO: 10045526 - DNA, 22 bp, Homo sapiens
gctggccattctctttgagatg

SEQ ID NO: 10045527 - DNA, 22 bp, Homo sapiens
ggcttctttttagtaaatgtca

SEQ ID NO: 10045528 - DNA, 22 bp, Homo sapiens
gccactgtactccagcctgcga

SEQ ID NO: 10045529 - DNA, 22 bp, Homo sapiens
gcagaggggaagctgaggaatt

SEQ ID NO: 10045530 - DNA, 22 bp, Homo sapiens
gcactgtgacagcaagagtgag

SEQ ID NO: 10045531 - DNA, 22 bp, Homo sapiens
gctcctggatgttcaagtcggc

SEQ ID NO: 10045532 - DNA, 18 bp, Homo sapiens
gaggtagataagattttc

SEQ ID NO: 10045533 - DNA, 22 bp, Homo sapiens
gaggtacatgaggatacacagg

SEQ ID NO: 10045534 - DNA, 22 bp, Homo sapiens
gaggtacagagtgttccaatgt

SEQ ID NO: 10045535 - DNA, 23 bp, Homo sapiens
gaggtacagcaccagtgaatagg

SEQ ID NO: 10045536 - DNA, 22 bp, Homo sapiens
gagaggtagaggctctgcttaa

SEQ ID NO: 10045537 - DNA, 22 bp, Homo sapiens
gagaggtagcagtaagaacagg

SEQ ID NO: 10045538 - DNA, 22 bp, Homo sapiens
atgaggcattccactcaaactc

SEQ ID NO: 10045539 - DNA, 22 bp, Homo sapiens
atgaggcatctgcagtcactag

SEQ ID NO: 10045540 - DNA, 22 bp, Homo sapiens
atgaatatgagactgagagcct

SEQ ID NO: 10045541 - DNA, 22 bp, Homo sapiens
atgaataaaacattttaatcag

SEQ ID NO: 10045542 - DNA, 22 bp, Homo sapiens
tcttagaaattccccagtggct

SEQ ID NO: 10045543 - DNA, 22 bp, Homo sapiens
ccaggctgtggtttagatagag

SEQ ID NO: 10045544 - DNA, 22 bp, Homo sapiens
tcttttggaaatgatgtgcagg

SEQ ID NO: 10045545 - DNA, 22 bp, Homo sapiens
tcttttgggttcttatgattta

SEQ ID NO: 10045546 - DNA, 22 bp, Homo sapiens
ccatcctatctgacctacttgt

SEQ ID NO: 10045547 - DNA, 22 bp, Homo sapiens
ccatcctgcattgctattcaga

SEQ ID NO: 10045548 - DNA, 22 bp, Homo sapiens
tgataaatccatgtaaatggta

SEQ ID NO: 10045549 - DNA, 22 bp, Homo sapiens
tgaggccagtctcatcacaggc

SEQ ID NO: 10045550 - DNA, 19 bp, Homo sapiens
ccatataaccagcaagtgt

SEQ ID NO: 10045551 - DNA, 22 bp, Homo sapiens
tggtaattaatttgataggttc

SEQ ID NO: 10045552 - DNA, 22 bp, Homo sapiens
tggtaatttacgcatttctgta

SEQ ID NO: 10045553 - DNA, 23 bp, Homo sapiens
tggccaagataatctcagttttc

SEQ ID NO: 10045554 - DNA, 22 bp, Homo sapiens
tggccaagaatgatatgtgaag

SEQ ID NO: 10045555 - DNA, 22 bp, Homo sapiens
tggccaaatttggtgtaacttg

SEQ ID NO: 10045556 - DNA, 22 bp, Homo sapiens
tggccaaagtagaaaataatag

SEQ ID NO: 10045557 - DNA, 21 bp, Homo sapiens
tggccaaactggagcatttga

SEQ ID NO: 10045558 - DNA, 21 bp, Homo sapiens
tggccaaaaccatattattaa

SEQ ID NO: 10045559 - DNA, 22 bp, Homo sapiens
cctcctggccctgggcctggaa

SEQ ID NO: 10045560 - DNA, 22 bp, Homo sapiens
cctcctggcctgtgcagagccc

SEQ ID NO: 10045561 - DNA, 22 bp, Homo sapiens
cctcctggcttttcccattgaa

SEQ ID NO: 10045562 - DNA, 22 bp, Homo sapiens
cctcctgggacaggctggcaca

SEQ ID NO: 10045563 - DNA, 22 bp, Homo sapiens
cctcctgggactcattagcacc

SEQ ID NO: 10045564 - DNA, 22 bp, Homo sapiens
cctcctgggctcctgtctgcac

SEQ ID NO: 10045565 - DNA, 22 bp, Homo sapiens
cctcctgggccttgctctgtga

SEQ ID NO: 10045566 - DNA, 23 bp, Homo sapiens
cctcctgggcacaggcctgatgg

SEQ ID NO: 10045567 - DNA, 22 bp, Homo sapiens
cctcctgggagagcacggaggg

SEQ ID NO: 10045568 - DNA, 22 bp, Homo sapiens
tggcttctttccactgtcctgt

SEQ ID NO: 10045569 - DNA, 22 bp, Homo sapiens
cctcctggtccagcatctcttt

SEQ ID NO: 10045570 - DNA, 22 bp, Homo sapiens
cctcctggtaattagcgaaagg

SEQ ID NO: 10045571 - DNA, 22 bp, Homo sapiens
cctcctggggtgaaggatggga

SEQ ID NO: 10045572 - DNA, 22 bp, Homo sapiens
cctcctgggttcaagcgattct

SEQ ID NO: 10045573 - DNA, 20 bp, Homo sapiens
cctcctggtcaggtgtgcag

SEQ ID NO: 10045574 - DNA, 22 bp, Homo sapiens
tggcagacactgtcgaagccta

SEQ ID NO: 10045575 - DNA, 21 bp, Homo sapiens
tggcagacaggaggagctcac

SEQ ID NO: 10045576 - DNA, 21 bp, Homo sapiens
tggcagactagagtatagatg

SEQ ID NO: 10045577 - DNA, 22 bp, Homo sapiens
tggcagactttagggtctacat

SEQ ID NO: 10045578 - DNA, 21 bp, Homo sapiens
tctctggttggagttgtgcca

SEQ ID NO: 10045579 - DNA, 22 bp, Homo sapiens
tctctgtacagtacatgccgtg

SEQ ID NO: 10045580 - DNA, 22 bp, Homo sapiens
tctctgtagttgggcagctgct

SEQ ID NO: 10045581 - DNA, 22 bp, Homo sapiens
tctataatcctatttcaactgc

SEQ ID NO: 10045582 - DNA, 22 bp, Homo sapiens
tcctggccttatccccaaactg

SEQ ID NO: 10045583 - DNA, 20 bp, Homo sapiens
tcctggccttctcgggcagt

SEQ ID NO: 10045584 - DNA, 22 bp, Homo sapiens
tcctggccttgcgtcttgggag

SEQ ID NO: 10045585 - DNA, 22 bp, Homo sapiens
tcctggccttgctcctgatgcc

SEQ ID NO: 10045586 - DNA, 22 bp, Homo sapiens
ccaccaggacagccctgagggg

SEQ ID NO: 10045587 - DNA, 22 bp, Homo sapiens
cattttatcctctgggaagcta

SEQ ID NO: 10045588 - DNA, 22 bp, Homo sapiens
cattaatattgttcttctttag

SEQ ID NO: 10045589 - DNA, 22 bp, Homo sapiens
cattaataaacatttcagaaga

SEQ ID NO: 10045590 - DNA, 22 bp, Homo sapiens
catcagagtggtggcctggtgt

SEQ ID NO: 10045591 - DNA, 20 bp, Homo sapiens
tcatcagataggttagtaca

SEQ ID NO: 10045592 - DNA, 22 bp, Homo sapiens
catcctggttaccccatagtca

SEQ ID NO: 10045593 - DNA, 22 bp, Homo sapiens
tcacttcacacccactatcatg

SEQ ID NO: 10045594 - DNA, 22 bp, Homo sapiens
tcactgttgacctggaagtggg

SEQ ID NO: 10045595 - DNA, 22 bp, Homo sapiens
catcagagtcagagctctttct

SEQ ID NO: 10045596 - DNA, 21 bp, Homo sapiens
catattaaatcggtgccttta

SEQ ID NO: 10045597 - DNA, 20 bp, Homo sapiens
tatataggaaatattgtgtt

SEQ ID NO: 10045598 - DNA, 22 bp, Homo sapiens
tagttttacttgcgatgataat

SEQ ID NO: 10045599 - DNA, 22 bp, Homo sapiens
tagtaaatctcagaaaaagatc

SEQ ID NO: 10045600 - DNA, 22 bp, Homo sapiens
tagtaaattaaaatattgactt

SEQ ID NO: 10045601 - DNA, 17 bp, Homo sapiens
tagtaaatgagtagagc

SEQ ID NO: 10045602 - DNA, 22 bp, Homo sapiens
cagtcttctaacctagcagcct

SEQ ID NO: 10045603 - DNA, 22 bp, Homo sapiens
cagtctctcagctttcagctgt

SEQ ID NO: 10045604 - DNA, 22 bp, Homo sapiens
cagtccctagtggagctcacag

SEQ ID NO: 10045605 - DNA, 22 bp, Homo sapiens
tcacattcatggtgctaataaa

SEQ ID NO: 10045606 - DNA, 22 bp, Homo sapiens
tcacattctcagcatctataca

SEQ ID NO: 10045607 - DNA, 22 bp, Homo sapiens
tacagcctcacatttacttaca

SEQ ID NO: 10045608 - DNA, 22 bp, Homo sapiens
ctgtatttgtcctctatttatt

SEQ ID NO: 10045609 - DNA, 22 bp, Homo sapiens
ctgcttccataaataatgtgct

SEQ ID NO: 10045610 - DNA, 22 bp, Homo sapiens
ctgggcaatatgctgggcctgg

SEQ ID NO: 10045611 - DNA, 23 bp, Homo sapiens
cttctggctctatatcagaattc

SEQ ID NO: 10045612 - DNA, 22 bp, Homo sapiens
ctttgattcagagagaattagc

SEQ ID NO: 10045613 - DNA, 22 bp, Homo sapiens
cttttgatagttgctgagcagg

SEQ ID NO: 10045614 - DNA, 22 bp, Homo sapiens
gaaacagcacgtttggagagat

SEQ ID NO: 10045615 - DNA, 22 bp, Homo sapiens
gaaaattattgaaaatggctct

SEQ ID NO: 10045616 - DNA, 22 bp, Homo sapiens
ctgtttttgtgctgtgtctccc

SEQ ID NO: 10045617 - DNA, 22 bp, Homo sapiens
ctgtttatagcagagcaagcct

SEQ ID NO: 10045618 - DNA, 22 bp, Homo sapiens
cttaggatgagtttttgcgttt

SEQ ID NO: 10045619 - DNA, 22 bp, Homo sapiens
cttaggatttaatttcagactc

SEQ ID NO: 10045620 - DNA, 22 bp, Homo sapiens
cttctattcactggtcacagtt

SEQ ID NO: 10045621 - DNA, 22 bp, Homo sapiens
gaggaacttatgatattctact

SEQ ID NO: 10045622 - DNA, 22 bp, Homo sapiens
gaggaacccagctggggttgcc

SEQ ID NO: 10045623 - DNA, 22 bp, Homo sapiens
gaggaaccactctgagaagcca

SEQ ID NO: 10045624 - DNA, 22 bp, Homo sapiens
gaggaaccaatctgtgatattc

SEQ ID NO: 10045625 - DNA, 22 bp, Homo sapiens
gaggaaccaaatcagcttgcac

SEQ ID NO: 10045626 - DNA, 22 bp, Homo sapiens
gaagggtgtgatttgcctgaga

SEQ ID NO: 10045627 - DNA, 22 bp, Homo sapiens
gactcctgcctcctctgtttgc

SEQ ID NO: 10045628 - DNA, 22 bp, Homo sapiens
gactcctggctttccctcttag

SEQ ID NO: 10045629 - DNA, 22 bp, Homo sapiens
gactcctgggcctctgagaggc

SEQ ID NO: 10045630 - DNA, 22 bp, Homo sapiens
ctctctggcacttcattgctgt

SEQ ID NO: 10045631 - DNA, 22 bp, Homo sapiens
ctctgacagccttcattatgca

SEQ ID NO: 10045632 - DNA, 22 bp, Homo sapiens
ctctctggacctcaactatttt

SEQ ID NO: 10045633 - DNA, 19 bp, Homo sapiens
tttcttaggcctttggcct

SEQ ID NO: 10045634 - DNA, 22 bp, Homo sapiens
tttcttagtcctagagtgattt

SEQ ID NO: 10045635 - DNA, 22 bp, Homo sapiens
tttgaataaacggttaatgttc

SEQ ID NO: 10045636 - DNA, 22 bp, Homo sapiens
ctccctggtgactcccaaagct

SEQ ID NO: 10045637 - DNA, 22 bp, Homo sapiens
ctccctggctttgtcctgaggc

SEQ ID NO: 10045638 - DNA, 22 bp, Homo sapiens
ctcctggaccagggctattggg

SEQ ID NO: 10045639 - DNA, 23 bp, Homo sapiens
ctcctggagggtccggccctgcc

SEQ ID NO: 10045640 - DNA, 22 bp, Homo sapiens
ctcctggaggatagtgactggg

SEQ ID NO: 10045641 - DNA, 22 bp, Homo sapiens
ctcctgcggtactactgtgctt

SEQ ID NO: 10045642 - DNA, 22 bp, Homo sapiens
ctcctggaagcccgccctgctg

SEQ ID NO: 10045643 - DNA, 22 bp, Homo sapiens
ctcctgtgggtcaccaataggc

SEQ ID NO: 10045644 - DNA, 22 bp, Homo sapiens
ctctaaatccaaataagtgtcc

SEQ ID NO: 10045645 - DNA, 22 bp, Homo sapiens
ctctaaatccacggtatagttg

SEQ ID NO: 10045646 - DNA, 22 bp, Homo sapiens
ctgaataattttatagttgctg

SEQ ID NO: 10045647 - DNA, 22 bp, Homo sapiens
ctgaataatattccattatgag

SEQ ID NO: 10045648 - DNA, 22 bp, Homo sapiens
ctgagcctgtgtttctctggca

SEQ ID NO: 10045649 - DNA, 22 bp, Homo sapiens
ctgaggaagacagcagctgtgt

SEQ ID NO: 10045650 - DNA, 22 bp, Homo sapiens
ctagtgaacgtggtactatgga

SEQ ID NO: 10045651 - DNA, 22 bp, Homo sapiens
ctataaatctacccagcattgg

SEQ ID NO: 10045652 - DNA, 22 bp, Homo sapiens
ctcactgtccaacaggctttac

SEQ ID NO: 10045653 - DNA, 22 bp, Homo sapiens
ctcactgtttaatagctggatc

SEQ ID NO: 10045654 - DNA, 22 bp, Homo sapiens
ctcactgtgccttttcccaaac

SEQ ID NO: 10045655 - DNA, 22 bp, Homo sapiens
ctcactgtgacctcagcagaca

SEQ ID NO: 10045656 - DNA, 22 bp, Homo sapiens
ctcactgtctgtactagctgat

SEQ ID NO: 10045657 - DNA, 21 bp, Homo sapiens
ttcttcatgatgattaatggc

SEQ ID NO: 10045658 - DNA, 22 bp, Homo sapiens
ttcttcatctgtaagataagca

SEQ ID NO: 10045659 - DNA, 23 bp, Homo sapiens
ttcttcattttcagagttgagca

SEQ ID NO: 10045660 - DNA, 22 bp, Homo sapiens
ttacaatagttccttcttttgt

SEQ ID NO: 10045661 - DNA, 22 bp, Homo sapiens
ttaaaatgaatattgattagca

SEQ ID NO: 10045662 - DNA, 22 bp, Homo sapiens
ttaataggcttctaacatagct

SEQ ID NO: 10045663 - DNA, 22 bp, Homo sapiens
ttaatagatatgcctctagagt

SEQ ID NO: 10045664 - DNA, 22 bp, Homo sapiens
tgttggcatctctgagagagtt

SEQ ID NO: 10045665 - DNA, 22 bp, Homo sapiens
tgttggcattagagggttattg

SEQ ID NO: 10045666 - DNA, 22 bp, Homo sapiens
tgttggcagattgtctagggtt

SEQ ID NO: 10045667 - DNA, 21 bp, Homo sapiens
cgcagagcgaacttgcggcgc

SEQ ID NO: 10045668 - DNA, 22 bp, Homo sapiens
ttatgtaggataatgaattgcc

SEQ ID NO: 10045669 - DNA, 22 bp, Homo sapiens
ttatgtagcagaaagatgtttg

SEQ ID NO: 10045670 - DNA, 22 bp, Homo sapiens
ttatgtagtgactgactgttag

SEQ ID NO: 10045671 - DNA, 22 bp, Homo sapiens
ttatggcatattcctcattgta

SEQ ID NO: 10045672 - DNA, 22 bp, Homo sapiens
ccttcttaaacatcattttggc

SEQ ID NO: 10045673 - DNA, 22 bp, Homo sapiens
taataaatgaaagtgctggcat

SEQ ID NO: 10045674 - DNA, 22 bp, Homo sapiens
tacaccttaatcatatgtgtct

SEQ ID NO: 10045675 - DNA, 22 bp, Homo sapiens
tacagcttttgcagctgttttg

SEQ ID NO: 10045676 - DNA, 22 bp, Homo sapiens
tacagcttatccagcttgatag

SEQ ID NO: 10045677 - DNA, 22 bp, Homo sapiens
tacagcttaaaagatgcattta

SEQ ID NO: 10045678 - DNA, 22 bp, Homo sapiens
tacagcttgatgtttgtgtgtt

SEQ ID NO: 10045679 - DNA, 22 bp, Homo sapiens
tacagctttagcaaattaccta

SEQ ID NO: 10045680 - DNA, 22 bp, Homo sapiens
tacagctttatacccatcaaaa

SEQ ID NO: 10045681 - DNA, 22 bp, Homo sapiens
tacagcttttcatatttgtgtt

SEQ ID NO: 10045682 - DNA, 22 bp, Homo sapiens
tacagctttgggaaggccccat

SEQ ID NO: 10045683 - DNA, 22 bp, Homo sapiens
tacagcttgacccataatgtct

SEQ ID NO: 10045684 - DNA, 22 bp, Homo sapiens
tacagcttcagtgtgccccagt

SEQ ID NO: 10045685 - DNA, 18 bp, Homo sapiens
tacagcttgagttgactg

SEQ ID NO: 10045686 - DNA, 22 bp, Homo sapiens
tacagcttgatgagagcgcgag

SEQ ID NO: 10045687 - DNA, 22 bp, Homo sapiens
tactgcctggagcattggtgct

SEQ ID NO: 10045688 - DNA, 23 bp, Homo sapiens
tacttaggaatggggacggcaag

SEQ ID NO: 10045689 - DNA, 20 bp, Homo sapiens
tacttaggcttgttttggcc

SEQ ID NO: 10045690 - DNA, 22 bp, Homo sapiens
tacttcctgtttccatgtctgt

SEQ ID NO: 10045691 - DNA, 22 bp, Homo sapiens
taccttttgcttattatgacac

SEQ ID NO: 10045692 - DNA, 22 bp, Homo sapiens
tactaaatgattaagcaggaat

SEQ ID NO: 10045693 - DNA, 22 bp, Homo sapiens
tacgcctgtaatcccagcactt

SEQ ID NO: 10045694 - DNA, 21 bp, Homo sapiens
taacacattttggtactttgg

SEQ ID NO: 10045695 - DNA, 22 bp, Homo sapiens
taagatagaactctgaggctac

SEQ ID NO: 10045696 - DNA, 22 bp, Homo sapiens
gttttatttccatgagagaccg

SEQ ID NO: 10045697 - DNA, 22 bp, Homo sapiens
gttttattggaacacagccatg

SEQ ID NO: 10045698 - DNA, 22 bp, Homo sapiens
taaacagctactgtgtcaaagg

SEQ ID NO: 10045699 - DNA, 22 bp, Homo sapiens
taaacagcctaaaactttcttt

SEQ ID NO: 10045700 - DNA, 22 bp, Homo sapiens
taaacagcctcccctttcactc

SEQ ID NO: 10045701 - DNA, 16 bp, Homo sapiens
taaacagcagacagtt

SEQ ID NO: 10045702 - DNA, 22 bp, Homo sapiens
gttaggatatggtgaaatggag

SEQ ID NO: 10045703 - DNA, 22 bp, Homo sapiens
gttaggatgtggggactttggg

SEQ ID NO: 10045704 - DNA, 22 bp, Homo sapiens
gttaggattatatatcccatga

SEQ ID NO: 10045705 - DNA, 22 bp, Homo sapiens
gttataaatacctaataggatt

SEQ ID NO: 10045706 - DNA, 22 bp, Homo sapiens
gttataaaggtgataatggtca

SEQ ID NO: 10045707 - DNA, 22 bp, Homo sapiens
gttataaatacctaataggatt

SEQ ID NO: 10045708 - DNA, 22 bp, Homo sapiens
gtgctttctgctgcattcctct

SEQ ID NO: 10045709 - DNA, 22 bp, Homo sapiens
tactttctgtccttctgttaaa

SEQ ID NO: 10045710 - DNA, 22 bp, Homo sapiens
tagaataagttgatgatatatg

SEQ ID NO: 10045711 - DNA, 22 bp, Homo sapiens
tagattttgcatttctaacaag

SEQ ID NO: 10045712 - DNA, 22 bp, Homo sapiens
tagattttacttctgtcattac

SEQ ID NO: 10045713 - DNA, 18 bp, Homo sapiens
tagattaaaattgaattc

SEQ ID NO: 10045714 - DNA, 22 bp, Homo sapiens
tagcactgaatcacatgctgct

SEQ ID NO: 10045715 - DNA, 22 bp, Homo sapiens
tagtcacaaccttcaagttgtc

SEQ ID NO: 10045716 - DNA, 22 bp, Homo sapiens
tagtcacatgatcacaggatcg

SEQ ID NO: 10045717 - DNA, 22 bp, Homo sapiens
tagtcacacaattgtgtacatt

SEQ ID NO: 10045718 - DNA, 22 bp, Homo sapiens
tagtcacagtacaggataaaga

SEQ ID NO: 10045719 - DNA, 22 bp, Homo sapiens
tagtcacaggaagtttcaatgt

SEQ ID NO: 10045720 - DNA, 18 bp, Homo sapiens
taggaagcttaatgtttt

SEQ ID NO: 10045721 - DNA, 22 bp, Homo sapiens
taggaagctctttgttttgtga

SEQ ID NO: 10045722 - DNA, 22 bp, Homo sapiens
taggaagcctaaattaagtggt

SEQ ID NO: 10045723 - DNA, 22 bp, Homo sapiens
tatcaatacatgttatcagtgt

SEQ ID NO: 10045724 - DNA, 22 bp, Homo sapiens
tatattagtggaatgatatgaa

SEQ ID NO: 10045725 - DNA, 22 bp, Homo sapiens
tatattaacttgtgatcctgga

SEQ ID NO: 10045726 - DNA, 22 bp, Homo sapiens
tatattaaccatagggttctag

SEQ ID NO: 10045727 - DNA, 22 bp, Homo sapiens
tatattaacacccacttgcctc

SEQ ID NO: 10045728 - DNA, 22 bp, Homo sapiens
tatattaaagtgctttgcagtg

SEQ ID NO: 10045729 - DNA, 22 bp, Homo sapiens
tatattaaaccctctctgtagg

SEQ ID NO: 10045730 - DNA, 22 bp, Homo sapiens
tatattaaatgaccagttttaa

SEQ ID NO: 10045731 - DNA, 22 bp, Homo sapiens
tatttgttgagttgttatgtct

SEQ ID NO: 10045732 - DNA, 22 bp, Homo sapiens
tattggtcttggaaggttttgt

SEQ ID NO: 10045733 - DNA, 22 bp, Homo sapiens
tatgtgtttgacaccctgcaag

SEQ ID NO: 10045734 - DNA, 22 bp, Homo sapiens
tattgaggattgaggaaagcac

SEQ ID NO: 10045735 - DNA, 22 bp, Homo sapiens
tattgatatgcagaactgactt

SEQ ID NO: 10045736 - DNA, 22 bp, Homo sapiens
tattgatgcttggattgggcca

SEQ ID NO: 10045737 - DNA, 22 bp, Homo sapiens
tattcagaaaataaattggatt

SEQ ID NO: 10045738 - DNA, 19 bp, Homo sapiens
tattcaggatgatggcaca

SEQ ID NO: 10045739 - DNA, 22 bp, Homo sapiens
tattcaaagtgcgaggtcaggg

SEQ ID NO: 10045740 - DNA, 22 bp, Homo sapiens
tattcacatgaaaacaaatttt

SEQ ID NO: 10045741 - DNA, 22 bp, Homo sapiens
tcccagagaaagtcaaggtctt

SEQ ID NO: 10045742 - DNA, 22 bp, Homo sapiens
tcccagagtgtgggcatcaagg

SEQ ID NO: 10045743 - DNA, 19 bp, Homo sapiens
tcccagagtctagaggttg

SEQ ID NO: 10045744 - DNA, 22 bp, Homo sapiens
tccacagaccagtatctgcagc

SEQ ID NO: 10045745 - DNA, 19 bp, Homo sapiens
tccacctttcttcatttgg

SEQ ID NO: 10045746 - DNA, 22 bp, Homo sapiens
tcactgtctgaaagaaatggcc

SEQ ID NO: 10045747 - DNA, 20 bp, Homo sapiens
tcacctttgttggtattcat

SEQ ID NO: 10045748 - DNA, 22 bp, Homo sapiens
tcaccgccttgcccggccgggc

SEQ ID NO: 10045749 - DNA, 20 bp, Homo sapiens
tcacatctggcagctgatga

SEQ ID NO: 10045750 - DNA, 22 bp, Homo sapiens
tcagagaggattttaataagtg

SEQ ID NO: 10045751 - DNA, 22 bp, Homo sapiens
tcagaggacagcagctaaataa

SEQ ID NO: 10045752 - DNA, 18 bp, Homo sapiens
tcagagagaatagtaatt

SEQ ID NO: 10045753 - DNA, 22 bp, Homo sapiens
tcagagacaccagagagctgtg

SEQ ID NO: 10045754 - DNA, 22 bp, Homo sapiens
tcaattctggtcctcaggaact

SEQ ID NO: 10045755 - DNA, 22 bp, Homo sapiens
tcaattcaacacatgcacattg

SEQ ID NO: 10045756 - DNA, 21 bp, Homo sapiens
tcacagagccacagaattggt

SEQ ID NO: 10045757 - DNA, 21 bp, Homo sapiens
tcacatctatgttaagcaaac

SEQ ID NO: 10045758 - DNA, 22 bp, Homo sapiens
tcacatctccctggaggacaca

SEQ ID NO: 10045759 - DNA, 23 bp, Homo sapiens
tcacatatcaagaaagtggtaga

SEQ ID NO: 10045760 - DNA, 22 bp, Homo sapiens
tcacatatttaagaaagttaaa

SEQ ID NO: 10045761 - DNA, 22 bp, Homo sapiens
tcagcctctctgagtccagacc

SEQ ID NO: 10045762 - DNA, 22 bp, Homo sapiens
gctcaagccttctgcccacctc

SEQ ID NO: 10045763 - DNA, 22 bp, Homo sapiens
gctcaagccttctgcccacctc

SEQ ID NO: 10045764 - DNA, 22 bp, Homo sapiens
gctcctggtgctgtagagattt

SEQ ID NO: 10045765 - DNA, 21 bp, Homo sapiens
gctcctggtgctgcgtggcgc

SEQ ID NO: 10045766 - DNA, 18 bp, Homo sapiens
gctcctggttggaaagaa

SEQ ID NO: 10045767 - DNA, 22 bp, Homo sapiens
gctcctggtctggagcttcaag

SEQ ID NO: 10045768 - DNA, 22 bp, Homo sapiens
gctcctggtgcaaagtttcttc

SEQ ID NO: 10045769 - DNA, 22 bp, Homo sapiens
gctgggttttcttccgggccta

SEQ ID NO: 10045770 - DNA, 23 bp, Homo sapiens
ggacactgctataaaggatctgc

SEQ ID NO: 10045771 - DNA, 21 bp, Homo sapiens
ggacactgataatcttgttgc

SEQ ID NO: 10045772 - DNA, 22 bp, Homo sapiens
ggacactgaagaatctcagatg

SEQ ID NO: 10045773 - DNA, 23 bp, Homo sapiens
ggacactgtgcagatgctagtgc

SEQ ID NO: 10045774 - DNA, 22 bp, Homo sapiens
ggacactgtataagttagagta

SEQ ID NO: 10045775 - DNA, 20 bp, Homo sapiens
ggacactgtagatttcaaac

SEQ ID NO: 10045776 - DNA, 22 bp, Homo sapiens
ggacactggccacatttcaaaa

SEQ ID NO: 10045777 - DNA, 22 bp, Homo sapiens
gcagagctccccaagacaccaa

SEQ ID NO: 10045778 - DNA, 22 bp, Homo sapiens
gcagcatattgtactggcctgc

SEQ ID NO: 10045779 - DNA, 22 bp, Homo sapiens
gcagcatacagggagagtactc

SEQ ID NO: 10045780 - DNA, 22 bp, Homo sapiens
gcataattaaacaggcaagatt

SEQ ID NO: 10045781 - DNA, 21 bp, Homo sapiens
gcagtcactcggttggctacc

SEQ ID NO: 10045782 - DNA, 22 bp, Homo sapiens
gggtatgatagggaggtgaaat

SEQ ID NO: 10045783 - DNA, 22 bp, Homo sapiens
gggtatgagatataggtgaata

SEQ ID NO: 10045784 - DNA, 22 bp, Homo sapiens
ggtcagccttggatttggtagc

SEQ ID NO: 10045785 - DNA, 22 bp, Homo sapiens
ggtggctgcaatggctaacttc

SEQ ID NO: 10045786 - DNA, 22 bp, Homo sapiens
ggtgaataagctgaacacttgg

SEQ ID NO: 10045787 - DNA, 22 bp, Homo sapiens
gtcttctgtaagatgaggtccc

SEQ ID NO: 10045788 - DNA, 22 bp, Homo sapiens
gtgataaaatagaaacagtggt

SEQ ID NO: 10045789 - DNA, 22 bp, Homo sapiens
gtctcctgagactgcagtcacc

SEQ ID NO: 10045790 - DNA, 22 bp, Homo sapiens
gtctcctgagccttgactgcaa

SEQ ID NO: 10045791 - DNA, 22 bp, Homo sapiens
gtcctctgaagttgtgcaatgc

SEQ ID NO: 10045792 - DNA, 22 bp, Homo sapiens
gtcaataattttatggagagaa

SEQ ID NO: 10045793 - DNA, 22 bp, Homo sapiens
gtcaataattgatagatattgg

SEQ ID NO: 10045794 - DNA, 22 bp, Homo sapiens
gtagccattggcaatgaagcct

SEQ ID NO: 10045795 - DNA, 22 bp, Homo sapiens
gtagaccatttatctggggagt

SEQ ID NO: 10045796 - DNA, 22 bp, Homo sapiens
gtaaatattccctcggttccta

SEQ ID NO: 10045797 - DNA, 22 bp, Homo sapiens
gtaatctcagctacttgggagg

SEQ ID NO: 10045798 - DNA, 22 bp, Homo sapiens
ggcgtttcaccatgttgaccag

SEQ ID NO: 10045799 - DNA, 22 bp, Homo sapiens
ggatttggaagaccgggtcaca

SEQ ID NO: 10045800 - DNA, 22 bp, Homo sapiens
ggatttgggcttgcagcagagc

SEQ ID NO: 10045801 - DNA, 22 bp, Homo sapiens
ttggcacacagtaagccctaag

SEQ ID NO: 10045802 - DNA, 22 bp, Homo sapiens
ttggcacagagctgcagcctgg

SEQ ID NO: 10045803 - DNA, 22 bp, Homo sapiens
ttggcagatttgtcagtaagct

SEQ ID NO: 10045804 - DNA, 20 bp, Homo sapiens
ttggcagcagctcagccacc

SEQ ID NO: 10045805 - DNA, 22 bp, Homo sapiens
ttggcagagagtatgctgaaga

SEQ ID NO: 10045806 - DNA, 22 bp, Homo sapiens
ttggcgcccaggacgccgccgc

SEQ ID NO: 10045807 - DNA, 22 bp, Homo sapiens
ttgggctcaggagtttgagacc

SEQ ID NO: 10045808 - DNA, 22 bp, Homo sapiens
ttgtgagtagtgccgcaataaa

SEQ ID NO: 10045809 - DNA, 22 bp, Homo sapiens
ttgttcataaagacagttcaga

SEQ ID NO: 10045810 - DNA, 22 bp, Homo sapiens
ttgttcatcaggtgacacatac

SEQ ID NO: 10045811 - DNA, 22 bp, Homo sapiens
ttgtgctgtgagaatgctcatt

SEQ ID NO: 10045812 - DNA, 22 bp, Homo sapiens
ttgtattcttccttagcagtac

SEQ ID NO: 10045813 - DNA, 22 bp, Homo sapiens
tttatgagcaccttggcccaga

SEQ ID NO: 10045814 - DNA, 22 bp, Homo sapiens
tttatgtaatttcataggtgtg

SEQ ID NO: 10045815 - DNA, 22 bp, Homo sapiens
tttatgtagttacggactatca

SEQ ID NO: 10045816 - DNA, 22 bp, Homo sapiens
tttaggatcaatgagaaagtct

SEQ ID NO: 10045817 - DNA, 22 bp, Homo sapiens
tttaggatgctctattctgact

SEQ ID NO: 10045818 - DNA, 22 bp, Homo sapiens
tttaggatctctcttgttacat

SEQ ID NO: 10045819 - DNA, 22 bp, Homo sapiens
tttaggataactccagttttcc

SEQ ID NO: 10045820 - DNA, 22 bp, Homo sapiens
tttaggatattaatgttcagag

SEQ ID NO: 10045821 - DNA, 19 bp, Homo sapiens
tttaggataaagtctggac

SEQ ID NO: 10045822 - DNA, 21 bp, Homo sapiens
tttatttatataggacacatg

SEQ ID NO: 10045823 - DNA, 22 bp, Homo sapiens
tttctaagacatttgtcatctt

SEQ ID NO: 10045824 - DNA, 22 bp, Homo sapiens
tttcatattgtccagtcagcgc

SEQ ID NO: 10045825 - DNA, 22 bp, Homo sapiens
ttctgagctgcaacactaacat

SEQ ID NO: 10045826 - DNA, 22 bp, Homo sapiens
ttctcttcccactttctgtatt

SEQ ID NO: 10045827 - DNA, 21 bp, Homo sapiens
ttctccccagcgaatcctcgg

SEQ ID NO: 10045828 - DNA, 22 bp, Homo sapiens
ttctcactatgtatgtagattg

SEQ ID NO: 10045829 - DNA, 22 bp, Homo sapiens
ttctcaaggacaaaatgacatg

SEQ ID NO: 10045830 - DNA, 22 bp, Homo sapiens
ttccctctcctactcaggaaag

SEQ ID NO: 10045831 - DNA, 22 bp, Homo sapiens
ttctaaattttggaagatgcag

SEQ ID NO: 10045832 - DNA, 22 bp, Homo sapiens
ttctttgagttagtacagtcca

SEQ ID NO: 10045833 - DNA, 22 bp, Homo sapiens
ttgagggtctggatctgctgct

SEQ ID NO: 10045834 - DNA, 22 bp, Homo sapiens
ttgaaacagtagctcatagacc

SEQ ID NO: 10045835 - DNA, 22 bp, Homo sapiens
ttcaatatctctaagaatgagg

SEQ ID NO: 10045836 - DNA, 22 bp, Homo sapiens
ttcaatatgatattagctgtgg

SEQ ID NO: 10045837 - DNA, 22 bp, Homo sapiens
ttcatataaatggaatcagaat

SEQ ID NO: 10045838 - DNA, 22 bp, Homo sapiens
ttcatatgtgaactcagtgatg

SEQ ID NO: 10045839 - DNA, 22 bp, Homo sapiens
ttccatatgtatatagctgtta

SEQ ID NO: 10045840 - DNA, 22 bp, Homo sapiens
ttccaagagctttaattgttga

SEQ ID NO: 10045841 - DNA, 22 bp, Homo sapiens
ttcccagacctgtaggatcaga

SEQ ID NO: 10045842 - DNA, 22 bp, Homo sapiens
ttcccagactccacactgaggc

SEQ ID NO: 10045843 - DNA, 22 bp, Homo sapiens
ttcccagagaaggatgaaaaag

SEQ ID NO: 10045844 - DNA, 22 bp, Homo sapiens
ttcccagagataagacgtctta

SEQ ID NO: 10045845 - DNA, 19 bp, Homo sapiens
ttcccagagccatgagtga

SEQ ID NO: 10045846 - DNA, 22 bp, Homo sapiens
ttcccagaggagatttgcttat

SEQ ID NO: 10045847 - DNA, 22 bp, Homo sapiens
ttagttaggaaacaaagttgtt

SEQ ID NO: 10045848 - DNA, 22 bp, Homo sapiens
ttataattctggcataggctgt

SEQ ID NO: 10045849 - DNA, 22 bp, Homo sapiens
ttatttagtctagatgaatttt

SEQ ID NO: 10045850 - DNA, 22 bp, Homo sapiens
tttttgtagtcattagaagagg

SEQ ID NO: 10045851 - DNA, 22 bp, Homo sapiens
ttttttagttaggtcagaatgt

SEQ ID NO: 10045852 - DNA, 22 bp, Homo sapiens
ttttttatatcaactgaagtct

SEQ ID NO: 10045853 - DNA, 20 bp, Homo sapiens
tttgtctgttaagtgtttct

SEQ ID NO: 10045854 - DNA, 22 bp, Homo sapiens
ttttacttaattcttggtcatg

SEQ ID NO: 10045855 - DNA, 22 bp, Homo sapiens
ttttattgtcaatgaagacaga

SEQ ID NO: 10045856 - DNA, 22 bp, Homo sapiens
tttctattctggatctgtggca

SEQ ID NO: 10045857 - DNA, 22 bp, Homo sapiens
acatccagatctcagcatggct

SEQ ID NO: 10045858 - DNA, 22 bp, Homo sapiens
acatttctagttgttcatctcc

SEQ ID NO: 10045859 - DNA, 20 bp, Homo sapiens
acaggggcagcacaataatg

SEQ ID NO: 10045860 - DNA, 20 bp, Homo sapiens
aggcactggatttcttatat

SEQ ID NO: 10045861 - DNA, 22 bp, Homo sapiens
acatagaaggaagagtagtagg

SEQ ID NO: 10045862 - DNA, 22 bp, Homo sapiens
acatattgagctctaaaagtac

SEQ ID NO: 10045863 - DNA, 21 bp, Homo sapiens
acagtctccccagatctctcc

SEQ ID NO: 10045864 - DNA, 22 bp, Homo sapiens
acagtctctccacactgcaggg

SEQ ID NO: 10045865 - DNA, 22 bp, Homo sapiens
aggacacacttctgaggtcttt

SEQ ID NO: 10045866 - DNA, 22 bp, Homo sapiens
actcctggtttgtgtcctggct

SEQ ID NO: 10045867 - DNA, 22 bp, Homo sapiens
actcctggttcccagttgagat

SEQ ID NO: 10045868 - DNA, 22 bp, Homo sapiens
actcctggtgctgatgaagaga

SEQ ID NO: 10045869 - DNA, 22 bp, Homo sapiens
actcctgggttgcagtcctcaa

SEQ ID NO: 10045870 - DNA, 17 bp, Homo sapiens
actcctggtctgaaggg

SEQ ID NO: 10045871 - DNA, 20 bp, Homo sapiens
actcctggtaacttttgtga

SEQ ID NO: 10045872 - DNA, 22 bp, Homo sapiens
actcctgggttctaaatttgaa

SEQ ID NO: 10045873 - DNA, 22 bp, Homo sapiens
actcctgggttccggagattct

SEQ ID NO: 10045874 - DNA, 19 bp, Homo sapiens
aggtctaatcataagacaa

SEQ ID NO: 10045875 - DNA, 22 bp, Homo sapiens
acgcctgtaatcccagcacttt

SEQ ID NO: 10045876 - DNA, 22 bp, Homo sapiens
acgcttttactattttgagctc

SEQ ID NO: 10045877 - DNA, 22 bp, Homo sapiens
atacattagctcatatgattaa

SEQ ID NO: 10045878 - DNA, 22 bp, Homo sapiens
acttctggatagagtcagcttt

SEQ ID NO: 10045879 - DNA, 22 bp, Homo sapiens
ataaaatttgctactgttaaat

SEQ ID NO: 10045880 - DNA, 22 bp, Homo sapiens
ataatcttgtatttcctaaagt

SEQ ID NO: 10045881 - DNA, 22 bp, Homo sapiens
ataagtaggaaaatttgaatat

SEQ ID NO: 10045882 - DNA, 22 bp, Homo sapiens
atattcatcgtgtagaaatact

SEQ ID NO: 10045883 - DNA, 22 bp, Homo sapiens
atattcattgaacacctactac

SEQ ID NO: 10045884 - DNA, 22 bp, Homo sapiens
atatttataagcaagcaggact

SEQ ID NO: 10045885 - DNA, 22 bp, Homo sapiens
actttctattcccacagagata

SEQ ID NO: 10045886 - DNA, 22 bp, Homo sapiens
atatggaagttacctgacttca

SEQ ID NO: 10045887 - DNA, 18 bp, Homo sapiens
atatggaatgcctggcta

SEQ ID NO: 10045888 - DNA, 22 bp, Homo sapiens
atatggaaatagcaatatggtt

SEQ ID NO: 10045889 - DNA, 22 bp, Homo sapiens
atatggaactattctgtgtaga

SEQ ID NO: 10045890 - DNA, 22 bp, Homo sapiens
atctaaaatgtggttagttggt

SEQ ID NO: 10045891 - DNA, 22 bp, Homo sapiens
caccgtttggtttggatttaca

SEQ ID NO: 10045892 - DNA, 22 bp, Homo sapiens
cacctctttgatttgaggcaag

SEQ ID NO: 10045893 - DNA, 22 bp, Homo sapiens
cactgctacctctgcctcccgg

SEQ ID NO: 10045894 - DNA, 22 bp, Homo sapiens
caacagctttagaaacactttc

SEQ ID NO: 10045895 - DNA, 22 bp, Homo sapiens
caacagctgatctttgatgaag

SEQ ID NO: 10045896 - DNA, 22 bp, Homo sapiens
caacagctcagacacgggacct

SEQ ID NO: 10045897 - DNA, 23 bp, Homo sapiens
caacagctgttagatatgggctt

SEQ ID NO: 10045898 - DNA, 22 bp, Homo sapiens
caacagctggaggcttggcccg

SEQ ID NO: 10045899 - DNA, 22 bp, Homo sapiens
caaatagtgtcacattgtgagg

SEQ ID NO: 10045900 - DNA, 22 bp, Homo sapiens
caaatagacttcaatctcttga

SEQ ID NO: 10045901 - DNA, 22 bp, Homo sapiens
agcacagtgcctgacatatatg

SEQ ID NO: 10045902 - DNA, 22 bp, Homo sapiens
agcacagtaattgatattactg

SEQ ID NO: 10045903 - DNA, 22 bp, Homo sapiens
cagagggaccagaacatactgt

SEQ ID NO: 10045904 - DNA, 22 bp, Homo sapiens
agccactcagtgctgtattgac

SEQ ID NO: 10045905 - DNA, 22 bp, Homo sapiens
agccactccttcagcgtctgct

SEQ ID NO: 10045906 - DNA, 22 bp, Homo sapiens
cagagggatcatcttcctgaag

SEQ ID NO: 10045907 - DNA, 22 bp, Homo sapiens
cagaggtattttgataaacgcc

SEQ ID NO: 10045908 - DNA, 22 bp, Homo sapiens
cagaggtattgcaaaagcctag

SEQ ID NO: 10045909 - DNA, 22 bp, Homo sapiens
cagaggtagggagctatgttat

SEQ ID NO: 10045910 - DNA, 22 bp, Homo sapiens
agcctgagccccatccagctga

SEQ ID NO: 10045911 - DNA, 22 bp, Homo sapiens
cagctcaggctctccatgctcc

SEQ ID NO: 10045912 - DNA, 22 bp, Homo sapiens
agctcagagataatcaagagac

SEQ ID NO: 10045913 - DNA, 22 bp, Homo sapiens
agctcctgaaaatccagactgg

SEQ ID NO: 10045914 - DNA, 22 bp, Homo sapiens
agagacagaggcaatatagctt

SEQ ID NO: 10045915 - DNA, 22 bp, Homo sapiens
agacagaccatggctattcaga

SEQ ID NO: 10045916 - DNA, 22 bp, Homo sapiens
attattaaagcttaggtcttat

SEQ ID NO: 10045917 - DNA, 23 bp, Homo sapiens
attattaaggacatggactttgt

SEQ ID NO: 10045918 - DNA, 22 bp, Homo sapiens
attattagtgatgttgttactg

SEQ ID NO: 10045919 - DNA, 22 bp, Homo sapiens
attattagattcttaattgtaa

SEQ ID NO: 10045920 - DNA, 22 bp, Homo sapiens
attattagacttatatggtagt

SEQ ID NO: 10045921 - DNA, 22 bp, Homo sapiens
attattaggactactggggttg

SEQ ID NO: 10045922 - DNA, 22 bp, Homo sapiens
attattaggtgctctctgacaa

SEQ ID NO: 10045923 - DNA, 22 bp, Homo sapiens
attattcaacacttgagaaatt

SEQ ID NO: 10045924 - DNA, 22 bp, Homo sapiens
attcatttaggtattcacttac

SEQ ID NO: 10045925 - DNA, 22 bp, Homo sapiens
attcatttgctattgtgtatgg

SEQ ID NO: 10045926 - DNA, 22 bp, Homo sapiens
atttggattcttatttagcact

SEQ ID NO: 10045927 - DNA, 21 bp, Homo sapiens
atttggatattgctggcaaat

SEQ ID NO: 10045928 - DNA, 22 bp, Homo sapiens
atttggcataggcagaggccca

SEQ ID NO: 10045929 - DNA, 22 bp, Homo sapiens
atttggcaaataatttgagggt

SEQ ID NO: 10045930 - DNA, 21 bp, Homo sapiens
atttggcaaaggcgatgcaca

SEQ ID NO: 10045931 - DNA, 22 bp, Homo sapiens
atttggcacactgggttctcgt

SEQ ID NO: 10045932 - DNA, 22 bp, Homo sapiens
agagttctgctcttctcagtga

SEQ ID NO: 10045933 - DNA, 22 bp, Homo sapiens
agagttctgctcttctcagtga

SEQ ID NO: 10045934 - DNA, 22 bp, Homo sapiens
agagttctgtctgccacacgaa

SEQ ID NO: 10045935 - DNA, 22 bp, Homo sapiens
agaggtattaggtaattcagta

SEQ ID NO: 10045936 - DNA, 22 bp, Homo sapiens
agaggtattagatttgcatagg

SEQ ID NO: 10045937 - DNA, 22 bp, Homo sapiens
agaggtatgtgtcagtgcttat

SEQ ID NO: 10045938 - DNA, 22 bp, Homo sapiens
atttcactcattcatgttactt

SEQ ID NO: 10045939 - DNA, 22 bp, Homo sapiens
aagcagctgatttcacagctca

SEQ ID NO: 10045940 - DNA, 22 bp, Homo sapiens
acagaggtttccattgaggttt

SEQ ID NO: 10045941 - DNA, 22 bp, Homo sapiens
acagagtaggtgctcagtaaat

SEQ ID NO: 10045942 - DNA, 18 bp, Homo sapiens
acagacaaaatggaaatg

SEQ ID NO: 10045943 - DNA, 22 bp, Homo sapiens
aactgctgtggcctagtactta

SEQ ID NO: 10045944 - DNA, 22 bp, Homo sapiens
aactgctggggaggccaaactc

SEQ ID NO: 10045945 - DNA, 22 bp, Homo sapiens
aactgcctggccaggctgcaac

SEQ ID NO: 10045946 - DNA, 22 bp, Homo sapiens
aatagttgtgaatcaggactag

SEQ ID NO: 10045947 - DNA, 22 bp, Homo sapiens
aacagcttgaggaatatcatca

SEQ ID NO: 10045948 - DNA, 22 bp, Homo sapiens
aaatgttccgggtaaggagaaa

SEQ ID NO: 10045949 - DNA, 22 bp, Homo sapiens
aaatgttcccaatatgaagctg

SEQ ID NO: 10045950 - DNA, 22 bp, Homo sapiens
aaactcctgcatactcagaagc

SEQ ID NO: 10045951 - DNA, 22 bp, Homo sapiens
aaactcctgggctcaagcagtt

SEQ ID NO: 10045952 - DNA, 22 bp, Homo sapiens
aaattagaaatactttcaaagc

SEQ ID NO: 10045953 - DNA, 22 bp, Homo sapiens
aaattagaagtgctcaggaata

SEQ ID NO: 10045954 - DNA, 22 bp, Homo sapiens
aaattagaccagggctcctgga

SEQ ID NO: 10045955 - DNA, 22 bp, Homo sapiens
aaacagcttgtaaggtgtaatt

SEQ ID NO: 10045956 - DNA, 22 bp, Homo sapiens
aaacagctgtcattgttttaaa

SEQ ID NO: 10045957 - DNA, 22 bp, Homo sapiens
aaacaatgtagattaccattta

SEQ ID NO: 10045958 - DNA, 22 bp, Homo sapiens
aaaccctgcccttcccaagatg

SEQ ID NO: 10045959 - DNA, 22 bp, Homo sapiens
aagcacagagaggtaaagtaac

SEQ ID NO: 10045960 - DNA, 22 bp, Homo sapiens
aaataactttctgtgtatagtc

SEQ ID NO: 10045961 - DNA, 22 bp, Homo sapiens
aaatagcttttcataattctca

SEQ ID NO: 10045962 - DNA, 22 bp, Homo sapiens
aaatactgtagataatagagtt

SEQ ID NO: 10045963 - DNA, 23 bp, Homo sapiens
aaatagagataggccagctttgc

SEQ ID NO: 10045964 - DNA, 22 bp, Homo sapiens
aaatagatttctctgggtttgt

SEQ ID NO: 10045965 - DNA, 22 bp, Homo sapiens
aaatagagctgggttaaacttt

SEQ ID NO: 10045966 - DNA, 22 bp, Homo sapiens
aaatagattgctgaggcattac

SEQ ID NO: 10045967 - DNA, 22 bp, Homo sapiens
aaatagatttcctagcattgga

SEQ ID NO: 10045968 - DNA, 22 bp, Homo sapiens
aactaaatctggcatttagagc

SEQ ID NO: 10045969 - DNA, 22 bp, Homo sapiens
aatgagtcaaaacagcatatag

SEQ ID NO: 10045970 - DNA, 22 bp, Homo sapiens
aatgagacacgtgaagcagatg

SEQ ID NO: 10045971 - DNA, 21 bp, Homo sapiens
agaaatacagcagggatgatc

SEQ ID NO: 10045972 - DNA, 22 bp, Homo sapiens
aatcctggaatacaagagtgaa

SEQ ID NO: 10045973 - DNA, 22 bp, Homo sapiens
aagtcacagctaaatagctaag

SEQ ID NO: 10045974 - DNA, 22 bp, Homo sapiens
actccaggttttttcactgaag

SEQ ID NO: 10045975 - DNA, 22 bp, Homo sapiens
aataagaattgccagatttgaa

SEQ ID NO: 10045976 - DNA, 22 bp, Homo sapiens
aataagatcctgaagatatgtt

SEQ ID NO: 10045977 - DNA, 22 bp, Homo sapiens
aataagatcttaaaggttatat

SEQ ID NO: 10045978 - DNA, 22 bp, Homo sapiens
aataattagtgggacagagaac

SEQ ID NO: 10045979 - DNA, 22 bp, Homo sapiens
aaggaacctggagtagagggag

SEQ ID NO: 10045980 - DNA, 22 bp, Homo sapiens
aaggaaccatttgtgtgcatgg

SEQ ID NO: 10045981 - DNA, 23 bp, Homo sapiens
acagaggtccaaacagtataagc

SEQ ID NO: 10045982 - DNA, 22 bp, Homo sapiens
agccattggctgcctggtgcgt

SEQ ID NO: 10045983 - DNA, 22 bp, Homo sapiens
acacatatatgtcgaagtcctc

SEQ ID NO: 10045984 - DNA, 23 bp, Homo sapiens
acacatttttcccgttctgaggt

SEQ ID NO: 10045985 - DNA, 22 bp, Homo sapiens
acacattttcaacactgtcaag

SEQ ID NO: 10045986 - DNA, 22 bp, Homo sapiens
aattaggagaaaactgttgtct

SEQ ID NO: 10045987 - DNA, 22 bp, Homo sapiens
aattaggaaatgagagtatttg

SEQ ID NO: 10045988 - DNA, 22 bp, Homo sapiens
aattaggaaattcagccatttt

SEQ ID NO: 10045989 - DNA, 22 bp, Homo sapiens
aattaggaataaatgagtactt

SEQ ID NO: 10045990 - DNA, 21 bp, Homo sapiens
agacactggtttagcattcat

SEQ ID NO: 10045991 - DNA, 22 bp, Homo sapiens
aatgtctgctctactcaggagg

SEQ ID NO: 10045992 - DNA, 22 bp, Homo sapiens
aatgtctgagtctctgtatccc

SEQ ID NO: 10045993 - DNA, 22 bp, Homo sapiens
aatgtctgccagaactgatcat

SEQ ID NO: 10045994 - DNA, 22 bp, Homo sapiens
ctttattagatgtagactttct

SEQ ID NO: 10045995 - DNA, 22 bp, Homo sapiens
ctttttatctcttaatgatgtt

SEQ ID NO: 10045996 - DNA, 23 bp, Homo sapiens
atgacactcctgtgcgcaccctg

SEQ ID NO: 10045997 - DNA, 22 bp, Homo sapiens
gaagccttgaactgcaaacccc

SEQ ID NO: 10045998 - DNA, 22 bp, Homo sapiens
gacagcttagtgaaaatgtaaa

SEQ ID NO: 10045999 - DNA, 22 bp, Homo sapiens
gacagcttaggaagtttctatt

SEQ ID NO: 10046000 - DNA, 22 bp, Homo sapiens
gacagcttcgaggaggtgagct

SEQ ID NO: 10046001 - DNA, 22 bp, Homo sapiens
gacagcttctagaaatggtcac

SEQ ID NO: 10046002 - DNA, 22 bp, Homo sapiens
gacagcttctatgtgacgagca

SEQ ID NO: 10046003 - DNA, 22 bp, Homo sapiens
gacagcttctagaggaattggt

SEQ ID NO: 10046004 - DNA, 22 bp, Homo sapiens
gacagcttcttgggccgggcct

SEQ ID NO: 10046005 - DNA, 22 bp, Homo sapiens
gacagcttgcctggtactgcaa

SEQ ID NO: 10046006 - DNA, 20 bp, Homo sapiens
gacagcttggggtgtcacct

SEQ ID NO: 10046007 - DNA, 22 bp, Homo sapiens
atgccactgcactccagcctgg

SEQ ID NO: 10046008 - DNA, 22 bp, Homo sapiens
atgccactgcactccagcctag

SEQ ID NO: 10046009 - DNA, 21 bp, Homo sapiens
atgtaggagttattggaacag

SEQ ID NO: 10046010 - DNA, 22 bp, Homo sapiens
atgtggcattcttggtcatttc

SEQ ID NO: 10046011 - DNA, 22 bp, Homo sapiens
atgtggcacagcacagtaagag

SEQ ID NO: 10046012 - DNA, 22 bp, Homo sapiens
gccatgcttggtatgctgtgag

SEQ ID NO: 10046013 - DNA, 22 bp, Homo sapiens
gccatgaggaactgtaagacaa

SEQ ID NO: 10046014 - DNA, 22 bp, Homo sapiens
gccagccagtttgctgatggct

SEQ ID NO: 10046015 - DNA, 22 bp, Homo sapiens
gccagccagagtggctgtgtgt

SEQ ID NO: 10046016 - DNA, 22 bp, Homo sapiens
atttattacctcggagtttctg

SEQ ID NO: 10046017 - DNA, 22 bp, Homo sapiens
atttattatgggatttggcaca

SEQ ID NO: 10046018 - DNA, 22 bp, Homo sapiens
atttattaagcatctgctatgt

SEQ ID NO: 10046019 - DNA, 22 bp, Homo sapiens
atttagtttaggaaaagtaggt

SEQ ID NO: 10046020 - DNA, 22 bp, Homo sapiens
atttgtcagtggaagtgattca

SEQ ID NO: 10046021 - DNA, 22 bp, Homo sapiens
atttgtcactgagagagttaga

SEQ ID NO: 10046022 - DNA, 22 bp, Homo sapiens
atttgtcatgtatgtaaagttg

SEQ ID NO: 10046023 - DNA, 22 bp, Homo sapiens
atttgtcaaaacacagagaaca

SEQ ID NO: 10046024 - DNA, 22 bp, Homo sapiens
attctctttgtataacatcttg

SEQ ID NO: 10046025 - DNA, 22 bp, Homo sapiens
attatggacgttaattttggaa

SEQ ID NO: 10046026 - DNA, 22 bp, Homo sapiens
attcaagtccagcttctctaca

SEQ ID NO: 10046027 - DNA, 22 bp, Homo sapiens
attcaagtggctgctatgttaa

SEQ ID NO: 10046028 - DNA, 22 bp, Homo sapiens
attcaagttcttctgtctttgc

SEQ ID NO: 10046029 - DNA, 22 bp, Homo sapiens
attataggcttgagccaccgtg

SEQ ID NO: 10046030 - DNA, 16 bp, Homo sapiens
cacatatatttatatg

SEQ ID NO: 10046031 - DNA, 22 bp, Homo sapiens
cacatatatgaaatgaggaatt

SEQ ID NO: 10046032 - DNA, 22 bp, Homo sapiens
cactgcactccagcctgggtga

SEQ ID NO: 10046033 - DNA, 22 bp, Homo sapiens
cactgcactccagcctgggtca

SEQ ID NO: 10046034 - DNA, 22 bp, Homo sapiens
cactgcaacctccacctcctgg

SEQ ID NO: 10046035 - DNA, 21 bp, Homo sapiens
cactccacttagaacagggtt

SEQ ID NO: 10046036 - DNA, 22 bp, Homo sapiens
cactctccagcacaccccattt

SEQ ID NO: 10046037 - DNA, 22 bp, Homo sapiens
cactcctgttccactaaatgag

SEQ ID NO: 10046038 - DNA, 23 bp, Homo sapiens
cactcctgtttctaagccagcat

SEQ ID NO: 10046039 - DNA, 23 bp, Homo sapiens
ggaagctcacgtagtcctgcact

SEQ ID NO: 10046040 - DNA, 22 bp, Homo sapiens
gtcagcagcatgtttaatcaaa

SEQ ID NO: 10046041 - DNA, 22 bp, Homo sapiens
gggtacttaatatttacggggt

SEQ ID NO: 10046042 - DNA, 22 bp, Homo sapiens
cccagagatgtcctgagtgata

SEQ ID NO: 10046043 - DNA, 22 bp, Homo sapiens
cctcctggaaaaattccctggc

SEQ ID NO: 10046044 - DNA, 22 bp, Homo sapiens
cctcctggagcattggtgagga

SEQ ID NO: 10046045 - DNA, 22 bp, Homo sapiens
cctcctggaggctctaagggag

SEQ ID NO: 10046046 - DNA, 22 bp, Homo sapiens
cctcctggaggctctagggaaa

SEQ ID NO: 10046047 - DNA, 22 bp, Homo sapiens
cctcctggatggatttggtgga

SEQ ID NO: 10046048 - DNA, 17 bp, Homo sapiens
catttgttgatcagttg

SEQ ID NO: 10046049 - DNA, 22 bp, Homo sapiens
catttgttggtcagattgtagt

SEQ ID NO: 10046050 - DNA, 22 bp, Homo sapiens
catttgtttagaagtctttata

SEQ ID NO: 10046051 - DNA, 22 bp, Homo sapiens
catttgttaaccagtgtggatt

SEQ ID NO: 10046052 - DNA, 22 bp, Homo sapiens
catttgttaattactattatct

SEQ ID NO: 10046053 - DNA, 20 bp, Homo sapiens
catttgttagctttctactg

SEQ ID NO: 10046054 - DNA, 22 bp, Homo sapiens
ccaagtgatacacccgcctcgg

SEQ ID NO: 10046055 - DNA, 22 bp, Homo sapiens
aggatgttatctgtgcaggtgg

SEQ ID NO: 10046056 - DNA, 22 bp, Homo sapiens
aggatgttgctattggcagtct

SEQ ID NO: 10046057 - DNA, 22 bp, Homo sapiens
aggatgttcgggtcacatagcc

SEQ ID NO: 10046058 - DNA, 22 bp, Homo sapiens
catattaaggtctgtaaggggt

SEQ ID NO: 10046059 - DNA, 22 bp, Homo sapiens
catagagtgatgtaaggtatgt

SEQ ID NO: 10046060 - DNA, 22 bp, Homo sapiens
catagattcttatttccatctt

SEQ ID NO: 10046061 - DNA, 22 bp, Homo sapiens
cagtttctatggctgggctctg

SEQ ID NO: 10046062 - DNA, 22 bp, Homo sapiens
cagtttctacgaaggtcaaccc

SEQ ID NO: 10046063 - DNA, 22 bp, Homo sapiens
cctggccagcagccccttcctc

SEQ ID NO: 10046064 - DNA, 22 bp, Homo sapiens
aggtataagtctcatttctgtt

SEQ ID NO: 10046065 - DNA, 22 bp, Homo sapiens
aggtatcaacagcagagtctga

SEQ ID NO: 10046066 - DNA, 22 bp, Homo sapiens
aggtatctggtaagaggcagac

SEQ ID NO: 10046067 - DNA, 17 bp, Homo sapiens
aggtataaaatggtagc

SEQ ID NO: 10046068 - DNA, 22 bp, Homo sapiens
cctgggcaggccggacgctggg

SEQ ID NO: 10046069 - DNA, 22 bp, Homo sapiens
agtcagagaccctagatctaat

SEQ ID NO: 10046070 - DNA, 22 bp, Homo sapiens
agtcactttatgagagaaccat

SEQ ID NO: 10046071 - DNA, 22 bp, Homo sapiens
cggtcaggtgcagcgttggcac

SEQ ID NO: 10046072 - DNA, 22 bp, Homo sapiens
cgtggccagccatttcctggaa

SEQ ID NO: 10046073 - DNA, 20 bp, Homo sapiens
cctttattatttgtatgatg

SEQ ID NO: 10046074 - DNA, 19 bp, Homo sapiens
aggtttctaactattcaag

SEQ ID NO: 10046075 - DNA, 22 bp, Homo sapiens
aggtttctatgctgtttatctt

SEQ ID NO: 10046076 - DNA, 21 bp, Homo sapiens
aggtttctcttttatggaggg

SEQ ID NO: 10046077 - DNA, 22 bp, Homo sapiens
agtaataatttatattagggag

SEQ ID NO: 10046078 - DNA, 22 bp, Homo sapiens
aggtgtggcttgaagtctctat

SEQ ID NO: 10046079 - DNA, 22 bp, Homo sapiens
cctggtccttacgtcattgctt

SEQ ID NO: 10046080 - DNA, 22 bp, Homo sapiens
ctgaagccatgtgctcactggt

SEQ ID NO: 10046081 - DNA, 22 bp, Homo sapiens
ctctgacaggtggcattatctc

SEQ ID NO: 10046082 - DNA, 22 bp, Homo sapiens
ctcccaggggaactatcaagta

SEQ ID NO: 10046083 - DNA, 22 bp, Homo sapiens
ctccagttggccccagttggtt

SEQ ID NO: 10046084 - DNA, 22 bp, Homo sapiens
ctgggccatggaagtctctgcc

SEQ ID NO: 10046085 - DNA, 22 bp, Homo sapiens
ctgggccagggaggtgtctgta

SEQ ID NO: 10046086 - DNA, 22 bp, Homo sapiens
ctgggccagttatgtctcatct

SEQ ID NO: 10046087 - DNA, 20 bp, Homo sapiens
ctgggccatccttttacaat

SEQ ID NO: 10046088 - DNA, 22 bp, Homo sapiens
ctgggccatctcctttgtgtgg

SEQ ID NO: 10046089 - DNA, 22 bp, Homo sapiens
atagtatttccagaaatagtct

SEQ ID NO: 10046090 - DNA, 22 bp, Homo sapiens
atagtcactctgttaggtgttt

SEQ ID NO: 10046091 - DNA, 22 bp, Homo sapiens
atatcacagtagttgtttagtt

SEQ ID NO: 10046092 - DNA, 22 bp, Homo sapiens
ctgtatgaggatcagactggac

SEQ ID NO: 10046093 - DNA, 22 bp, Homo sapiens
ctgtatttcccacattctctat

SEQ ID NO: 10046094 - DNA, 22 bp, Homo sapiens
ctgtcatttaagacattctgga

SEQ ID NO: 10046095 - DNA, 22 bp, Homo sapiens
atctcataaacacacatatatg

SEQ ID NO: 10046096 - DNA, 22 bp, Homo sapiens
atcaggatgtttggctgtcata

SEQ ID NO: 10046097 - DNA, 22 bp, Homo sapiens
atcaggatgggtttggcttagg

SEQ ID NO: 10046098 - DNA, 22 bp, Homo sapiens
atcaggatccaccttgagcctg

SEQ ID NO: 10046099 - DNA, 22 bp, Homo sapiens
atcaggatctgcatcataagaa

SEQ ID NO: 10046100 - DNA, 22 bp, Homo sapiens
atcaggatcagggctagcagag

SEQ ID NO: 10046101 - DNA, 22 bp, Homo sapiens
ctgtttattacactggatagca

SEQ ID NO: 10046102 - DNA, 22 bp, Homo sapiens
ctgtttatggaggtaaggcatc

SEQ ID NO: 10046103 - DNA, 22 bp, Homo sapiens
ctgtttatctaggagttgcagg

SEQ ID NO: 10046104 - DNA, 22 bp, Homo sapiens
ctgtttatccctttggtcagca

SEQ ID NO: 10046105 - DNA, 22 bp, Homo sapiens
atcattaaatataagcttcaca

SEQ ID NO: 10046106 - DNA, 22 bp, Homo sapiens
ataataaaccaggatgggtctg

SEQ ID NO: 10046107 - DNA, 22 bp, Homo sapiens
ataataaaccaggatgggtctg

SEQ ID NO: 10046108 - DNA, 22 bp, Homo sapiens
agttttcagtaaatattagtga

SEQ ID NO: 10046109 - DNA, 22 bp, Homo sapiens
agtttctctttgacaccaaaat

SEQ ID NO: 10046110 - DNA, 22 bp, Homo sapiens
agtttctcttaatctagtatct

SEQ ID NO: 10046111 - DNA, 22 bp, Homo sapiens
agtttctctcagtatagaatag

SEQ ID NO: 10046112 - DNA, 22 bp, Homo sapiens
agtttctctagagtctttgaaa

SEQ ID NO: 10046113 - DNA, 18 bp, Homo sapiens
agtgttaagtaagtagca

SEQ ID NO: 10046114 - DNA, 22 bp, Homo sapiens
agtgttaatggtgtatattagg

SEQ ID NO: 10046115 - DNA, 22 bp, Homo sapiens
atagaatatgacttttagatcc

SEQ ID NO: 10046116 - DNA, 22 bp, Homo sapiens
ataattatctcagacacttgtt

SEQ ID NO: 10046117 - DNA, 17 bp, Homo sapiens
tcacagttggtctcagt

SEQ ID NO: 10046118 - DNA, 22 bp, Homo sapiens
tcacagttatagtctgtagaat

SEQ ID NO: 10046119 - DNA, 22 bp, Homo sapiens
tcacagttatagtctgtagaat

SEQ ID NO: 10046120 - DNA, 22 bp, Homo sapiens
caggtttctagttctaagaata

SEQ ID NO: 10046121 - DNA, 22 bp, Homo sapiens
cagttaaacgggccatgtgagt

SEQ ID NO: 10046122 - DNA, 22 bp, Homo sapiens
cagtgtctccagatgctccaat

SEQ ID NO: 10046123 - DNA, 22 bp, Homo sapiens
tagataaattagaaagtttact

SEQ ID NO: 10046124 - DNA, 22 bp, Homo sapiens
tcccagagctgataagccttta

SEQ ID NO: 10046125 - DNA, 22 bp, Homo sapiens
tcccagagctctggaggttgga

SEQ ID NO: 10046126 - DNA, 22 bp, Homo sapiens
tcccagagctctgacaccagct

SEQ ID NO: 10046127 - DNA, 22 bp, Homo sapiens
tcccagagcctctgccactctg

SEQ ID NO: 10046128 - DNA, 22 bp, Homo sapiens
tccagcctaggggaacagctgc

SEQ ID NO: 10046129 - DNA, 22 bp, Homo sapiens
catcttttggcctattctgagg

SEQ ID NO: 10046130 - DNA, 22 bp, Homo sapiens
tccacatagtcattaatttctg

SEQ ID NO: 10046131 - DNA, 22 bp, Homo sapiens
tctcaaatttgttagataaaat

SEQ ID NO: 10046132 - DNA, 22 bp, Homo sapiens
tctcaaatttatacagagttca

SEQ ID NO: 10046133 - DNA, 22 bp, Homo sapiens
ccactttgagaagctgatgaaa

SEQ ID NO: 10046134 - DNA, 18 bp, Homo sapiens
ccactttgcagcctggcc

SEQ ID NO: 10046135 - DNA, 22 bp, Homo sapiens
ccactttgaaccactgaggtgg

SEQ ID NO: 10046136 - DNA, 22 bp, Homo sapiens
ccacccttgggttcggaggccg

SEQ ID NO: 10046137 - DNA, 22 bp, Homo sapiens
tctcctggctcaccaggctgga

SEQ ID NO: 10046138 - DNA, 22 bp, Homo sapiens
tctcctggccgggctgtcccct

SEQ ID NO: 10046139 - DNA, 22 bp, Homo sapiens
tctcctggcctttaggttaagg

SEQ ID NO: 10046140 - DNA, 23 bp, Homo sapiens
tctcctggctgcactgtggccac

SEQ ID NO: 10046141 - DNA, 17 bp, Homo sapiens
tctcctggctctatcag

SEQ ID NO: 10046142 - DNA, 22 bp, Homo sapiens
tctcctggctctaaaaggctgt

SEQ ID NO: 10046143 - DNA, 22 bp, Homo sapiens
tgtcaaatttttattgcagtat

SEQ ID NO: 10046144 - DNA, 22 bp, Homo sapiens
tgctttcaaaggctttctagat

SEQ ID NO: 10046145 - DNA, 22 bp, Homo sapiens
tggaggtgagtgtggtacagca

SEQ ID NO: 10046146 - DNA, 22 bp, Homo sapiens
cctcactgaagaggtgacattt

SEQ ID NO: 10046147 - DNA, 22 bp, Homo sapiens
cctcactgctatgtgtttgctc

SEQ ID NO: 10046148 - DNA, 22 bp, Homo sapiens
cccagagatcttgtcctttcca

SEQ ID NO: 10046149 - DNA, 22 bp, Homo sapiens
cccagagaagtgaagtgacttg

SEQ ID NO: 10046150 - DNA, 22 bp, Homo sapiens
cccagagaatctttcagaaagg

SEQ ID NO: 10046151 - DNA, 22 bp, Homo sapiens
cccagagaattccacatagagg

SEQ ID NO: 10046152 - DNA, 22 bp, Homo sapiens
cccaagagatcgcatgtagttg

SEQ ID NO: 10046153 - DNA, 23 bp, Homo sapiens
tgattaggtctactcttggctcc

SEQ ID NO: 10046154 - DNA, 22 bp, Homo sapiens
tctttattttatgcttgtgcaa

SEQ ID NO: 10046155 - DNA, 22 bp, Homo sapiens
ccaggctgagcatgattggagc

SEQ ID NO: 10046156 - DNA, 22 bp, Homo sapiens
ccaggctgcagtcaaggggcat

SEQ ID NO: 10046157 - DNA, 22 bp, Homo sapiens
ccaggctgccgaggaaagaaag

SEQ ID NO: 10046158 - DNA, 22 bp, Homo sapiens
tgaaggaatgagtatactgttt

SEQ ID NO: 10046159 - DNA, 22 bp, Homo sapiens
tgaggaatgctgagcagaggaa

SEQ ID NO: 10046160 - DNA, 22 bp, Homo sapiens
tgaccaaaaaattccctgtgag

SEQ ID NO: 10046161 - DNA, 22 bp, Homo sapiens
ccagggaaaatcaacttctact

SEQ ID NO: 10046162 - DNA, 22 bp, Homo sapiens
ctgcccaaatccttcttcctct

SEQ ID NO: 10046163 - DNA, 22 bp, Homo sapiens
ctctctgttatgctttcatgaa

SEQ ID NO: 10046164 - DNA, 22 bp, Homo sapiens
tttctcaaatactgttccagga

SEQ ID NO: 10046165 - DNA, 22 bp, Homo sapiens
tttctattttaaaggcatatgg

SEQ ID NO: 10046166 - DNA, 22 bp, Homo sapiens
tttcattataaaaagttggctt

SEQ ID NO: 10046167 - DNA, 18 bp, Homo sapiens
tttatgagctgtgggacc

SEQ ID NO: 10046168 - DNA, 22 bp, Homo sapiens
ctctgtgcttatgctccatggg

SEQ ID NO: 10046169 - DNA, 22 bp, Homo sapiens
ctctggcctggggcctgctccc

SEQ ID NO: 10046170 - DNA, 22 bp, Homo sapiens
ctctggcctgcagatccatgct

SEQ ID NO: 10046171 - DNA, 22 bp, Homo sapiens
ccttttctaatcttaagaatgt

SEQ ID NO: 10046172 - DNA, 23 bp, Homo sapiens
ttattgagggtgtagattggtgt

SEQ ID NO: 10046173 - DNA, 22 bp, Homo sapiens
ttaaatagtaggtctattttgg

SEQ ID NO: 10046174 - DNA, 23 bp, Homo sapiens
ttataaatattttcaggtgtgtt

SEQ ID NO: 10046175 - DNA, 22 bp, Homo sapiens
ttatcacttatgagctttttgc

SEQ ID NO: 10046176 - DNA, 18 bp, Homo sapiens
ctcaccattctgcccaat

SEQ ID NO: 10046177 - DNA, 22 bp, Homo sapiens
ttctttctctactagcagagct

SEQ ID NO: 10046178 - DNA, 22 bp, Homo sapiens
ctcagagagttaagtgaattac

SEQ ID NO: 10046179 - DNA, 22 bp, Homo sapiens
ctgtcattgagcctgtcagggc

SEQ ID NO: 10046180 - DNA, 22 bp, Homo sapiens
ctgggccagcaactgcaatgga

SEQ ID NO: 10046181 - DNA, 22 bp, Homo sapiens
ctggtcaaggagagtctctgca

SEQ ID NO: 10046182 - DNA, 22 bp, Homo sapiens
ctggtgtcattttagcctcagg

SEQ ID NO: 10046183 - DNA, 22 bp, Homo sapiens
ctggtgtctgctccctcacagc

SEQ ID NO: 10046184 - DNA, 22 bp, Homo sapiens
ctggtgtctgattctcccctga

SEQ ID NO: 10046185 - DNA, 22 bp, Homo sapiens
ctggtacaaaatgctgatatca

SEQ ID NO: 10046186 - DNA, 22 bp, Homo sapiens
gaaacagctttaagtgatactg

SEQ ID NO: 10046187 - DNA, 22 bp, Homo sapiens
gaaacagctagaaagccattgg

SEQ ID NO: 10046188 - DNA, 22 bp, Homo sapiens
gaaacagcccctgtgtgaagca

SEQ ID NO: 10046189 - DNA, 22 bp, Homo sapiens
gaaatattacagtggaggggat

SEQ ID NO: 10046190 - DNA, 22 bp, Homo sapiens
gaaatattacagtggaggggat

SEQ ID NO: 10046191 - DNA, 22 bp, Homo sapiens
gaaatattcttgtcttgttttc

SEQ ID NO: 10046192 - DNA, 22 bp, Homo sapiens
gaaatattcttgtcttgttttc

SEQ ID NO: 10046193 - DNA, 22 bp, Homo sapiens
gaaatattgggactcagagctt

SEQ ID NO: 10046194 - DNA, 22 bp, Homo sapiens
gaaatattgtactggagatgtt

SEQ ID NO: 10046195 - DNA, 22 bp, Homo sapiens
gaaatattgtactggagatgtt

SEQ ID NO: 10046196 - DNA, 22 bp, Homo sapiens
gaaattcaaaatgtcagtatag

SEQ ID NO: 10046197 - DNA, 22 bp, Homo sapiens
cttgcttacctagttagctcca

SEQ ID NO: 10046198 - DNA, 22 bp, Homo sapiens
gagcactgatttatttttgtct

SEQ ID NO: 10046199 - DNA, 22 bp, Homo sapiens
gaccttcttgctgtgtcctaac

SEQ ID NO: 10046200 - DNA, 22 bp, Homo sapiens
gaggacaggagactcactgttt

SEQ ID NO: 10046201 - DNA, 22 bp, Homo sapiens
gaggtttcttatcaagaaagct

SEQ ID NO: 10046202 - DNA, 22 bp, Homo sapiens
gaggtttcactgtgttgtccag

SEQ ID NO: 10046203 - DNA, 22 bp, Homo sapiens
gctggccacagatccccaggga

SEQ ID NO: 10046204 - DNA, 22 bp, Homo sapiens
gctggccaaagtgtacctggag

SEQ ID NO: 10046205 - DNA, 22 bp, Homo sapiens
gctggccacactgctgatggag

SEQ ID NO: 10046206 - DNA, 22 bp, Homo sapiens
gctggccacattgtgccgtcct

SEQ ID NO: 10046207 - DNA, 19 bp, Homo sapiens
gctggccacgccccagttg

SEQ ID NO: 10046208 - DNA, 22 bp, Homo sapiens
gctggccagccctcttcctcca

SEQ ID NO: 10046209 - DNA, 22 bp, Homo sapiens
gctggccaggaagagtctcaga

SEQ ID NO: 10046210 - DNA, 22 bp, Homo sapiens
gctgtctcatacaaggccctgc

SEQ ID NO: 10046211 - DNA, 22 bp, Homo sapiens
ggacagagggttgacagagtat

SEQ ID NO: 10046212 - DNA, 22 bp, Homo sapiens
ggagctgttggcagctatcttg

SEQ ID NO: 10046213 - DNA, 22 bp, Homo sapiens
ggagctgttcaggactgcttca

SEQ ID NO: 10046214 - DNA, 22 bp, Homo sapiens
ggagctgtgcagtgactacaga

SEQ ID NO: 10046215 - DNA, 23 bp, Homo sapiens
gcagaggtttttcagtatggttt

SEQ ID NO: 10046216 - DNA, 22 bp, Homo sapiens
gccattttctgtcttgtttatt

SEQ ID NO: 10046217 - DNA, 22 bp, Homo sapiens
ggtaaaaatcacaaatacttta

SEQ ID NO: 10046218 - DNA, 22 bp, Homo sapiens
gtctagagtgcttcctagtcat

SEQ ID NO: 10046219 - DNA, 22 bp, Homo sapiens
gtcactgtatccaggttccagc

SEQ ID NO: 10046220 - DNA, 22 bp, Homo sapiens
gtcagacaggaatgttgcaagt

SEQ ID NO: 10046221 - DNA, 18 bp, Homo sapiens
gtcactgtgtttctgagc

SEQ ID NO: 10046222 - DNA, 22 bp, Homo sapiens
gtcactgtttcctattatattt

SEQ ID NO: 10046223 - DNA, 22 bp, Homo sapiens
gtcctctggaagatgagttctt

SEQ ID NO: 10046224 - DNA, 21 bp, Homo sapiens
gtcaaacttgcaccagtgccc

SEQ ID NO: 10046225 - DNA, 22 bp, Homo sapiens
gtcaaatatatgcaaaactatt

SEQ ID NO: 10046226 - DNA, 18 bp, Homo sapiens
gtaggtcagtaccaagca

SEQ ID NO: 10046227 - DNA, 22 bp, Homo sapiens
gggagctgaatggcaatggaga

SEQ ID NO: 10046228 - DNA, 22 bp, Homo sapiens
taattattgtctgaagagttat

SEQ ID NO: 10046229 - DNA, 22 bp, Homo sapiens
taattattctagtcacatagca

SEQ ID NO: 10046230 - DNA, 22 bp, Homo sapiens
taattattatgacaacaattgc

SEQ ID NO: 10046231 - DNA, 22 bp, Homo sapiens
taattatttgaagacattagag

SEQ ID NO: 10046232 - DNA, 22 bp, Homo sapiens
taagctgtgggagattggcata

SEQ ID NO: 10046233 - DNA, 22 bp, Homo sapiens
taataggagccaggtcacatag

SEQ ID NO: 10046234 - DNA, 22 bp, Homo sapiens
taatagttgtgactttgtaaag

SEQ ID NO: 10046235 - DNA, 22 bp, Homo sapiens
tactcctgctgatcctgccagc

SEQ ID NO: 10046236 - DNA, 22 bp, Homo sapiens
taccatttcattctttcctcat

SEQ ID NO: 10046237 - DNA, 22 bp, Homo sapiens
tactaggaagcagctgcattgg

SEQ ID NO: 10046238 - DNA, 22 bp, Homo sapiens
gtttattatacaacaaaagcta

SEQ ID NO: 10046239 - DNA, 22 bp, Homo sapiens
gtttattaactgtcaagtgatt

SEQ ID NO: 10046240 - DNA, 22 bp, Homo sapiens
gtttattagagttttctgtctg

SEQ ID NO: 10046241 - DNA, 22 bp, Homo sapiens
gtttcacagatggggagacacg

SEQ ID NO: 10046242 - DNA, 22 bp, Homo sapiens
gtgttgatgacattttagaaac

SEQ ID NO: 10046243 - DNA, 22 bp, Homo sapiens
taacagctggcgttataggaat

SEQ ID NO: 10046244 - DNA, 22 bp, Homo sapiens
taacagctctgtgtggctgtaa

SEQ ID NO: 10046245 - DNA, 22 bp, Homo sapiens
tagttagggttctgcagagaca

SEQ ID NO: 10046246 - DNA, 22 bp, Homo sapiens
tagttttataatgttaacatct

SEQ ID NO: 10046247 - DNA, 22 bp, Homo sapiens
tagctgctgcagcacagggagg

SEQ ID NO: 10046248 - DNA, 22 bp, Homo sapiens
tagagtctagtgtatacaaagt

SEQ ID NO: 10046249 - DNA, 22 bp, Homo sapiens
tagatactcagaaatgctttca

SEQ ID NO: 10046250 - DNA, 22 bp, Homo sapiens
tattttctggacagtcttgctt

SEQ ID NO: 10046251 - DNA, 22 bp, Homo sapiens
tattttctgtggaggaccagat

SEQ ID NO: 10046252 - DNA, 22 bp, Homo sapiens
tcaaatgagaggcagggcagct

SEQ ID NO: 10046253 - DNA, 22 bp, Homo sapiens
tatgtaggtaaacacagacata

SEQ ID NO: 10046254 - DNA, 22 bp, Homo sapiens
tattaataaatatgtaggggcc

SEQ ID NO: 10046255 - DNA, 22 bp, Homo sapiens
tattaacatgaactgacttttc

SEQ ID NO: 10046256 - DNA, 22 bp, Homo sapiens
tattaataagtgactactagct

SEQ ID NO: 10046257 - DNA, 21 bp, Homo sapiens
tattaatatgtctaagctgat

SEQ ID NO: 10046258 - DNA, 22 bp, Homo sapiens
tattaatatgtgtgtgcatgta

SEQ ID NO: 10046259 - DNA, 22 bp, Homo sapiens
tattaaattatggatttaggag

SEQ ID NO: 10046260 - DNA, 22 bp, Homo sapiens
tatcacatcaatgttttaaaat

SEQ ID NO: 10046261 - DNA, 22 bp, Homo sapiens
tatcacatttggagatttatga

SEQ ID NO: 10046262 - DNA, 22 bp, Homo sapiens
tatcacatagtgtttagtaaat

SEQ ID NO: 10046263 - DNA, 22 bp, Homo sapiens
tatgaaatttaaacacagatca

SEQ ID NO: 10046264 - DNA, 22 bp, Homo sapiens
tatgaaattgccatttttatgg

SEQ ID NO: 10046265 - DNA, 22 bp, Homo sapiens
tatgaatataccacaatttagg

SEQ ID NO: 10046266 - DNA, 22 bp, Homo sapiens
tatgaatataccacaatttagg

SEQ ID NO: 10046267 - DNA, 22 bp, Homo sapiens
tcatctgtcccaggcttttttc

SEQ ID NO: 10046268 - DNA, 22 bp, Homo sapiens
tcataaattatctatttggcta

SEQ ID NO: 10046269 - DNA, 23 bp, Homo sapiens
tcataaatattagcacagtagga

SEQ ID NO: 10046270 - DNA, 22 bp, Homo sapiens
tcataaatcatactccatttgc

SEQ ID NO: 10046271 - DNA, 22 bp, Homo sapiens
tcagtctcatcaactctattcc

SEQ ID NO: 10046272 - DNA, 20 bp, Homo sapiens
tcattgtgttgccaattccc

SEQ ID NO: 10046273 - DNA, 22 bp, Homo sapiens
tcattgttatgttttgctgtct

SEQ ID NO: 10046274 - DNA, 19 bp, Homo sapiens
tcattgttggtttgtcggg

SEQ ID NO: 10046275 - DNA, 22 bp, Homo sapiens
tcatttaataatttttgagtag

SEQ ID NO: 10046276 - DNA, 22 bp, Homo sapiens
tcatttaatagcttttgtcttt

SEQ ID NO: 10046277 - DNA, 22 bp, Homo sapiens
tcatttttcacacagggtcacc

SEQ ID NO: 10046278 - DNA, 22 bp, Homo sapiens
tcatttgtacttgtgtgcttgt

SEQ ID NO: 10046279 - DNA, 21 bp, Homo sapiens
tcatttgtgatctgatttcca

SEQ ID NO: 10046280 - DNA, 22 bp, Homo sapiens
tcactgcaacctccacctcctg

SEQ ID NO: 10046281 - DNA, 22 bp, Homo sapiens
tcactgctgctgccatgatgga

SEQ ID NO: 10046282 - DNA, 22 bp, Homo sapiens
tcactgctctccaatgtggagt

SEQ ID NO: 10046283 - DNA, 22 bp, Homo sapiens
tcactgcaacctccacctcccg

SEQ ID NO: 10046284 - DNA, 22 bp, Homo sapiens
tcaggacagaaggctgccaggg

SEQ ID NO: 10046285 - DNA, 22 bp, Homo sapiens
tcaggacatttgtcagcaggag

SEQ ID NO: 10046286 - DNA, 20 bp, Homo sapiens
tcctgagcctccaccatgtc

SEQ ID NO: 10046287 - DNA, 22 bp, Homo sapiens
tcctgagcttcaaaacactttg

SEQ ID NO: 10046288 - DNA, 22 bp, Homo sapiens
tcctgagctgccgcatcagcag

SEQ ID NO: 10046289 - DNA, 22 bp, Homo sapiens
tcccagaggctccagtctctat

SEQ ID NO: 10046290 - DNA, 22 bp, Homo sapiens
tcccagaggttgagtcacttat

SEQ ID NO: 10046291 - DNA, 22 bp, Homo sapiens
tcccagagtattagcaattgct

SEQ ID NO: 10046292 - DNA, 22 bp, Homo sapiens
tccattcattcattgatgaaca

SEQ ID NO: 10046293 - DNA, 22 bp, Homo sapiens
tcccaagagctctgggataagg

SEQ ID NO: 10046294 - DNA, 22 bp, Homo sapiens
tcccaaagtattagcatttcaa

SEQ ID NO: 10046295 - DNA, 22 bp, Homo sapiens
tcccagagccaagctatggatg

SEQ ID NO: 10046296 - DNA, 22 bp, Homo sapiens
tcccagagcagatgtgctaaag

SEQ ID NO: 10046297 - DNA, 22 bp, Homo sapiens
tcccagagcagtactccaggag

SEQ ID NO: 10046298 - DNA, 22 bp, Homo sapiens
tcccagagacagagcctcctcc

SEQ ID NO: 10046299 - DNA, 22 bp, Homo sapiens
tcccagagacatcatttctccg

SEQ ID NO: 10046300 - DNA, 22 bp, Homo sapiens
tcccagagatttcctctccttc

SEQ ID NO: 10046301 - DNA, 22 bp, Homo sapiens
tcctaggcagttggtgctccat

SEQ ID NO: 10046302 - DNA, 22 bp, Homo sapiens
tttatatagagatttgtgcatg

SEQ ID NO: 10046303 - DNA, 22 bp, Homo sapiens
tttatatttcccaggattggcc

SEQ ID NO: 10046304 - DNA, 22 bp, Homo sapiens
tttatcagagatatgtgtggac

SEQ ID NO: 10046305 - DNA, 22 bp, Homo sapiens
tttcattattcatgctagttat

SEQ ID NO: 10046306 - DNA, 22 bp, Homo sapiens
tttcattcattatacagtagag

SEQ ID NO: 10046307 - DNA, 22 bp, Homo sapiens
ttgacacagttttctcattaag

SEQ ID NO: 10046308 - DNA, 22 bp, Homo sapiens
ttgacacagtcaacttgatttt

SEQ ID NO: 10046309 - DNA, 22 bp, Homo sapiens
ttgacacattagagcttgtaaa

SEQ ID NO: 10046310 - DNA, 22 bp, Homo sapiens
ttgacacaatgtatattttcaa

SEQ ID NO: 10046311 - DNA, 22 bp, Homo sapiens
ttgacacagatcaatattcaac

SEQ ID NO: 10046312 - DNA, 22 bp, Homo sapiens
ttgctgaattgaatcctttggt

SEQ ID NO: 10046313 - DNA, 21 bp, Homo sapiens
ttgcttatggcactgctttgc

SEQ ID NO: 10046314 - DNA, 22 bp, Homo sapiens
ttgctgaaaacagtgggtattg

SEQ ID NO: 10046315 - DNA, 22 bp, Homo sapiens
ttgctgaaatctatgacatcct

SEQ ID NO: 10046316 - DNA, 22 bp, Homo sapiens
ttgctgaagtgaaggtatgttt

SEQ ID NO: 10046317 - DNA, 22 bp, Homo sapiens
ttgctgaagttaatgcttgcaa

SEQ ID NO: 10046318 - DNA, 20 bp, Homo sapiens
ttggcagcttcagggtacta

SEQ ID NO: 10046319 - DNA, 19 bp, Homo sapiens
ttggcagctgagatcctgc

SEQ ID NO: 10046320 - DNA, 22 bp, Homo sapiens
ttggcagcccagcttactagca

SEQ ID NO: 10046321 - DNA, 23 bp, Homo sapiens
ttggcagcgggtcaggctgtggg

SEQ ID NO: 10046322 - DNA, 22 bp, Homo sapiens
ttggcagcatccaagtctcggg

SEQ ID NO: 10046323 - DNA, 20 bp, Homo sapiens
ttggcagcagttccaagtga

SEQ ID NO: 10046324 - DNA, 22 bp, Homo sapiens
ttggcagcagggagttggccgc

SEQ ID NO: 10046325 - DNA, 22 bp, Homo sapiens
ttggcatcagtgtaggacctgt

SEQ ID NO: 10046326 - DNA, 22 bp, Homo sapiens
ttattaatgagtacaagttatt

SEQ ID NO: 10046327 - DNA, 22 bp, Homo sapiens
ttattaatcttatctttggaaa

SEQ ID NO: 10046328 - DNA, 22 bp, Homo sapiens
ttattaatacatgcacctgcat

SEQ ID NO: 10046329 - DNA, 22 bp, Homo sapiens
ttattaataaagtggcatagcc

SEQ ID NO: 10046330 - DNA, 22 bp, Homo sapiens
ttattagagatatttggttagg

SEQ ID NO: 10046331 - DNA, 22 bp, Homo sapiens
ttattagggtggtttatgttct

SEQ ID NO: 10046332 - DNA, 22 bp, Homo sapiens
ttattaggttattctctgtact

SEQ ID NO: 10046333 - DNA, 22 bp, Homo sapiens
ttattaggtttacataaaggtt

SEQ ID NO: 10046334 - DNA, 22 bp, Homo sapiens
ttattagtgttgatattaggat

SEQ ID NO: 10046335 - DNA, 22 bp, Homo sapiens
ttattaggaactcaggattttt

SEQ ID NO: 10046336 - DNA, 22 bp, Homo sapiens
ttattaggaaaaggtcagatgt

SEQ ID NO: 10046337 - DNA, 22 bp, Homo sapiens
ttattagagtgctttgagaaag

SEQ ID NO: 10046338 - DNA, 22 bp, Homo sapiens
ttattatggtatttctttgcag

SEQ ID NO: 10046339 - DNA, 21 bp, Homo sapiens
ttattgagacatttgtggaaa

SEQ ID NO: 10046340 - DNA, 22 bp, Homo sapiens
ttattgagcacatagtatgtgg

SEQ ID NO: 10046341 - DNA, 22 bp, Homo sapiens
ttcaaactcttgctctgctagt

SEQ ID NO: 10046342 - DNA, 22 bp, Homo sapiens
ttagccattttatacaagtgta

SEQ ID NO: 10046343 - DNA, 22 bp, Homo sapiens
ttagccattgtcagcacatggc

SEQ ID NO: 10046344 - DNA, 22 bp, Homo sapiens
ttagccattaaattacaaggtg

SEQ ID NO: 10046345 - DNA, 22 bp, Homo sapiens
ttagccatgtgggaaaaacagc

SEQ ID NO: 10046346 - DNA, 22 bp, Homo sapiens
ttagccatggactgaattgact

SEQ ID NO: 10046347 - DNA, 22 bp, Homo sapiens
ttagccattaatgtcctgtgca

SEQ ID NO: 10046348 - DNA, 22 bp, Homo sapiens
ttagccatatagaaaaagagct

SEQ ID NO: 10046349 - DNA, 22 bp, Homo sapiens
ttagccatgccctagaagagga

SEQ ID NO: 10046350 - DNA, 19 bp, Homo sapiens
ttagccatccacagtgaaa

SEQ ID NO: 10046351 - DNA, 22 bp, Homo sapiens
ttatagatttttatgaagtctg

SEQ ID NO: 10046352 - DNA, 22 bp, Homo sapiens
ttatacatgtgttttgagatga

SEQ ID NO: 10046353 - DNA, 20 bp, Homo sapiens
ttcacagaggactcaggtca

SEQ ID NO: 10046354 - DNA, 22 bp, Homo sapiens
ttcacagatgagaaaattgagg

SEQ ID NO: 10046355 - DNA, 22 bp, Homo sapiens
ttcacagatgtattggaactcc

SEQ ID NO: 10046356 - DNA, 22 bp, Homo sapiens
ttcattgtctctgtttgccttc

SEQ ID NO: 10046357 - DNA, 22 bp, Homo sapiens
ttcattgtgaacacattctgcc

SEQ ID NO: 10046358 - DNA, 22 bp, Homo sapiens
ttcattgtgattcttggctagc

SEQ ID NO: 10046359 - DNA, 22 bp, Homo sapiens
ttcatttgccatcagtgtaatg

SEQ ID NO: 10046360 - DNA, 22 bp, Homo sapiens
ttcatttgtggttatttacaat

SEQ ID NO: 10046361 - DNA, 22 bp, Homo sapiens
ttcatttgtctgctatagatcc

SEQ ID NO: 10046362 - DNA, 23 bp, Homo sapiens
ttcatttgtctacttcacttgtt

SEQ ID NO: 10046363 - DNA, 22 bp, Homo sapiens
ttcctggcaccaccacttctag

SEQ ID NO: 10046364 - DNA, 22 bp, Homo sapiens
ttcctggccccacccctggaga

SEQ ID NO: 10046365 - DNA, 23 bp, Homo sapiens
ttcctggcaggtacaacttttac

SEQ ID NO: 10046366 - DNA, 22 bp, Homo sapiens
ttcctggcatgaaaaatatcac

SEQ ID NO: 10046367 - DNA, 22 bp, Homo sapiens
ttcctggcatagagagggcaca

SEQ ID NO: 10046368 - DNA, 21 bp, Homo sapiens
ttcctggcggcagaaacgtga

SEQ ID NO: 10046369 - DNA, 22 bp, Homo sapiens
ttcctggcgccacggagccggt

SEQ ID NO: 10046370 - DNA, 22 bp, Homo sapiens
ttcctggcctctctctgagcag

SEQ ID NO: 10046371 - DNA, 22 bp, Homo sapiens
ttctcctctgttggccttccct

SEQ ID NO: 10046372 - DNA, 22 bp, Homo sapiens
ttcttaggactagtatagcatg

SEQ ID NO: 10046373 - DNA, 22 bp, Homo sapiens
ttcttttgggaattacgtatgc

SEQ ID NO: 10046374 - DNA, 23 bp, Homo sapiens
ttcttatttactttggaatctcc

SEQ ID NO: 10046375 - DNA, 22 bp, Homo sapiens
ttcttattcttgaaatgtggga

SEQ ID NO: 10046376 - DNA, 22 bp, Homo sapiens
tttgttaattcttatgttagag

SEQ ID NO: 10046377 - DNA, 22 bp, Homo sapiens
tttgttaaatatttattgagtg

SEQ ID NO: 10046378 - DNA, 22 bp, Homo sapiens
ttttaattgcaattatggtccc

SEQ ID NO: 10046379 - DNA, 22 bp, Homo sapiens
ttttatgattgagctggctaca

SEQ ID NO: 10046380 - DNA, 22 bp, Homo sapiens
ttttatgtgctggactggcagt

SEQ ID NO: 10046381 - DNA, 22 bp, Homo sapiens
ttttattatctttgaatgggac

SEQ ID NO: 10046382 - DNA, 21 bp, Homo sapiens
ttttattgatgaatggccact

SEQ ID NO: 10046383 - DNA, 22 bp, Homo sapiens
ttttattagtggctagatgggg

SEQ ID NO: 10046384 - DNA, 22 bp, Homo sapiens
ttttcattgttactatgagcta

SEQ ID NO: 10046385 - DNA, 22 bp, Homo sapiens
ttttcattgttcctcgagcatt

SEQ ID NO: 10046386 - DNA, 22 bp, Homo sapiens
tttttatatgaaggatagtgcg

SEQ ID NO: 10046387 - DNA, 22 bp, Homo sapiens
tttttcaagacaacctgcatgt

SEQ ID NO: 10046388 - DNA, 22 bp, Homo sapiens
tttttagtagaggtgggtttca

SEQ ID NO: 10046389 - DNA, 22 bp, Homo sapiens
acaccatggttcccaaactgtg

SEQ ID NO: 10046390 - DNA, 22 bp, Homo sapiens
acacagttggtggctcagtctg

SEQ ID NO: 10046391 - DNA, 22 bp, Homo sapiens
acacagtttatggtattctgtt

SEQ ID NO: 10046392 - DNA, 22 bp, Homo sapiens
acacagttctttcactgttggt

SEQ ID NO: 10046393 - DNA, 22 bp, Homo sapiens
acagaggtcatggagagttctc

SEQ ID NO: 10046394 - DNA, 22 bp, Homo sapiens
acagaggtaggacatgagatat

SEQ ID NO: 10046395 - DNA, 22 bp, Homo sapiens
acagaggtcacctttgtatctt

SEQ ID NO: 10046396 - DNA, 22 bp, Homo sapiens
aattcatatggatatgctagta

SEQ ID NO: 10046397 - DNA, 22 bp, Homo sapiens
aattaatatttgtggaattaat

SEQ ID NO: 10046398 - DNA, 22 bp, Homo sapiens
agaggaatctgtctagacacaa

SEQ ID NO: 10046399 - DNA, 22 bp, Homo sapiens
agaggaataaatttctgtagtg

SEQ ID NO: 10046400 - DNA, 22 bp, Homo sapiens
aatgccttggagagcctagagg

SEQ ID NO: 10046401 - DNA, 22 bp, Homo sapiens
acacaaattgtaggataattgc

SEQ ID NO: 10046402 - DNA, 22 bp, Homo sapiens
aatttcttgggagctcagagaa

SEQ ID NO: 10046403 - DNA, 22 bp, Homo sapiens
acaaataggtagatttgcaaca

SEQ ID NO: 10046404 - DNA, 22 bp, Homo sapiens
acaaatagaaaatctggattgg

SEQ ID NO: 10046405 - DNA, 22 bp, Homo sapiens
acaaagtgctgacattacaggc

SEQ ID NO: 10046406 - DNA, 22 bp, Homo sapiens
acatcctgaagtcagtcatttg

SEQ ID NO: 10046407 - DNA, 22 bp, Homo sapiens
acctatttatgcaattatgaaa

SEQ ID NO: 10046408 - DNA, 18 bp, Homo sapiens
actctttctgcccacagg

SEQ ID NO: 10046409 - DNA, 22 bp, Homo sapiens
actcttttataaagcatcttga

SEQ ID NO: 10046410 - DNA, 22 bp, Homo sapiens
aataaaatgaactggtagagtt

SEQ ID NO: 10046411 - DNA, 22 bp, Homo sapiens
aataatagcagagtttacaatc

SEQ ID NO: 10046412 - DNA, 22 bp, Homo sapiens
aataagttgcctgttgaatcat

SEQ ID NO: 10046413 - DNA, 22 bp, Homo sapiens
aatgaagaaatggacatcttta

SEQ ID NO: 10046414 - DNA, 22 bp, Homo sapiens
aatagcttatgggatagatgtt

SEQ ID NO: 10046415 - DNA, 22 bp, Homo sapiens
aatagcttagtcctgattctgt

SEQ ID NO: 10046416 - DNA, 22 bp, Homo sapiens
aatcacagagtccagcagatga

SEQ ID NO: 10046417 - DNA, 23 bp, Homo sapiens
aaaacagcttcctccagtggctc

SEQ ID NO: 10046418 - DNA, 22 bp, Homo sapiens
aacttctgggctgtccaaaact

SEQ ID NO: 10046419 - DNA, 22 bp, Homo sapiens
aacttctggatgtttcaaatgt

SEQ ID NO: 10046420 - DNA, 22 bp, Homo sapiens
aagaagctgtagggattaactc

SEQ ID NO: 10046421 - DNA, 23 bp, Homo sapiens
aaatattcttttttagtaagtgc

SEQ ID NO: 10046422 - DNA, 23 bp, Homo sapiens
aaatattcttttttagtaagtgc

SEQ ID NO: 10046423 - DNA, 22 bp, Homo sapiens
aaatcactaagttatagtgtgg

SEQ ID NO: 10046424 - DNA, 22 bp, Homo sapiens
aatataattttattcctagagt

SEQ ID NO: 10046425 - DNA, 22 bp, Homo sapiens
aatatctgtggccatacaattt

SEQ ID NO: 10046426 - DNA, 22 bp, Homo sapiens
aatgaaatctgctgggtaaaga

SEQ ID NO: 10046427 - DNA, 22 bp, Homo sapiens
acacagctagtgagtggcagag

SEQ ID NO: 10046428 - DNA, 23 bp, Homo sapiens
aagccccaaggaacttcctggga

SEQ ID NO: 10046429 - DNA, 22 bp, Homo sapiens
acagccaggagccatgggcagg

SEQ ID NO: 10046430 - DNA, 20 bp, Homo sapiens
acacatatagcagcataaac

SEQ ID NO: 10046431 - DNA, 22 bp, Homo sapiens
acacatatatacatatttgtgc

SEQ ID NO: 10046432 - DNA, 22 bp, Homo sapiens
acagtggagaaggcatgaggct

SEQ ID NO: 10046433 - DNA, 22 bp, Homo sapiens
acatatatgtaaagtactttgt

SEQ ID NO: 10046434 - DNA, 22 bp, Homo sapiens
agaagctgcgtttatttaaatc

SEQ ID NO: 10046435 - DNA, 22 bp, Homo sapiens
atattaattatttacacatgag

SEQ ID NO: 10046436 - DNA, 22 bp, Homo sapiens
atatagtttaagaaagtacagt

SEQ ID NO: 10046437 - DNA, 22 bp, Homo sapiens
atattaatgggatttagtcagg

SEQ ID NO: 10046438 - DNA, 22 bp, Homo sapiens
atattaatgagcaagtaagtga

SEQ ID NO: 10046439 - DNA, 22 bp, Homo sapiens
atattaagatgctattggtttt

SEQ ID NO: 10046440 - DNA, 22 bp, Homo sapiens
atagctttcttaaatatataaa

SEQ ID NO: 10046441 - DNA, 22 bp, Homo sapiens
atagctgttagattggggtcga

SEQ ID NO: 10046442 - DNA, 22 bp, Homo sapiens
atagtgttacccttcttaaagt

SEQ ID NO: 10046443 - DNA, 22 bp, Homo sapiens
atagaatagcatagaaaattga

SEQ ID NO: 10046444 - DNA, 22 bp, Homo sapiens
atactgtttctcttctacatga

SEQ ID NO: 10046445 - DNA, 22 bp, Homo sapiens
atactgttttgtgacttatctt

SEQ ID NO: 10046446 - DNA, 22 bp, Homo sapiens
caaacatttgacttctctcagg

SEQ ID NO: 10046447 - DNA, 22 bp, Homo sapiens
attgaaaaatgactattgctta

SEQ ID NO: 10046448 - DNA, 22 bp, Homo sapiens
attcggatcatgtgtatgtgtt

SEQ ID NO: 10046449 - DNA, 20 bp, Homo sapiens
attctaaagctctgctcttt

SEQ ID NO: 10046450 - DNA, 22 bp, Homo sapiens
attaataaaataccactttgtt

SEQ ID NO: 10046451 - DNA, 22 bp, Homo sapiens
attatttgacttgagaacaggt

SEQ ID NO: 10046452 - DNA, 22 bp, Homo sapiens
attaaatactgcaggctaagca

SEQ ID NO: 10046453 - DNA, 22 bp, Homo sapiens
agagctctgcagctggcctcag

SEQ ID NO: 10046454 - DNA, 22 bp, Homo sapiens
attaaggaatgtaggcaagaag

SEQ ID NO: 10046455 - DNA, 21 bp, Homo sapiens
atgtagggtttgccttctcta

SEQ ID NO: 10046456 - DNA, 22 bp, Homo sapiens
atgaggcaatcatggtccagtt

SEQ ID NO: 10046457 - DNA, 22 bp, Homo sapiens
atgaggattaactgttgtcata

SEQ ID NO: 10046458 - DNA, 22 bp, Homo sapiens
atgattggtggtcagcagtatg

SEQ ID NO: 10046459 - DNA, 22 bp, Homo sapiens
atgccacttcattccagcctcg

SEQ ID NO: 10046460 - DNA, 22 bp, Homo sapiens
agcgccactgcactccagcctg

SEQ ID NO: 10046461 - DNA, 22 bp, Homo sapiens
cagcctttaagcttggataggt

SEQ ID NO: 10046462 - DNA, 22 bp, Homo sapiens
cagccttcgacagttggagtag

SEQ ID NO: 10046463 - DNA, 22 bp, Homo sapiens
cagcctttgggtcagaagattc

SEQ ID NO: 10046464 - DNA, 22 bp, Homo sapiens
cagccttttccatgtattgttg

SEQ ID NO: 10046465 - DNA, 22 bp, Homo sapiens
cagcctttgtgaacatcaggtg

SEQ ID NO: 10046466 - DNA, 22 bp, Homo sapiens
cagccttttaggactatttgtg

SEQ ID NO: 10046467 - DNA, 22 bp, Homo sapiens
cagatgaactgtgactgaaaat

SEQ ID NO: 10046468 - DNA, 22 bp, Homo sapiens
caattatatttagaatgataca

SEQ ID NO: 10046469 - DNA, 20 bp, Homo sapiens
cacaggaaagctactcagtt

SEQ ID NO: 10046470 - DNA, 22 bp, Homo sapiens
cacacttttggcatgtttggtt

SEQ ID NO: 10046471 - DNA, 20 bp, Homo sapiens
cacgtttttccactagcaaa

SEQ ID NO: 10046472 - DNA, 22 bp, Homo sapiens
cactgcactccagcccgggcaa

SEQ ID NO: 10046473 - DNA, 22 bp, Homo sapiens
cactgcacttcagcctgggtga

SEQ ID NO: 10046474 - DNA, 22 bp, Homo sapiens
gacctttttactgtgtacgctg

SEQ ID NO: 10046475 - DNA, 23 bp, Homo sapiens
gacacctttgccagatcaagatg

SEQ ID NO: 10046476 - DNA, 22 bp, Homo sapiens
atggccaagagtcgatttgggg

SEQ ID NO: 10046477 - DNA, 22 bp, Homo sapiens
atggccaagaagtattcctgac

SEQ ID NO: 10046478 - DNA, 22 bp, Homo sapiens
atggccaagaatatttctcaac

SEQ ID NO: 10046479 - DNA, 22 bp, Homo sapiens
atggccaagcatatacagattg

SEQ ID NO: 10046480 - DNA, 22 bp, Homo sapiens
atggccaagatcacagacttca

SEQ ID NO: 10046481 - DNA, 22 bp, Homo sapiens
atggccaactgaaatgaaagat

SEQ ID NO: 10046482 - DNA, 20 bp, Homo sapiens
atggccaacctgcttatgac

SEQ ID NO: 10046483 - DNA, 22 bp, Homo sapiens
atggccaaatctaaactgttgg

SEQ ID NO: 10046484 - DNA, 22 bp, Homo sapiens
atggccaagaaattgccgactg

SEQ ID NO: 10046485 - DNA, 22 bp, Homo sapiens
atggccaaataacagcttgcat

SEQ ID NO: 10046486 - DNA, 22 bp, Homo sapiens
atggccaaagccacagcagagg

SEQ ID NO: 10046487 - DNA, 22 bp, Homo sapiens
atggccaaggggcctaggcagg

SEQ ID NO: 10046488 - DNA, 22 bp, Homo sapiens
atggccaagcatgcctgtggcc

SEQ ID NO: 10046489 - DNA, 22 bp, Homo sapiens
atggccaagcttactctgttgt

SEQ ID NO: 10046490 - DNA, 21 bp, Homo sapiens
atggtggcacaaatttgatct

SEQ ID NO: 10046491 - DNA, 18 bp, Homo sapiens
atggtctcatactgggag

SEQ ID NO: 10046492 - DNA, 22 bp, Homo sapiens
atgttggccaggctggtcttga

SEQ ID NO: 10046493 - DNA, 20 bp, Homo sapiens
gagttccccatttctcctgg

SEQ ID NO: 10046494 - DNA, 22 bp, Homo sapiens
atgttctgttttgtaattcata

SEQ ID NO: 10046495 - DNA, 22 bp, Homo sapiens
atgtagagcagtgttgtccaat

SEQ ID NO: 10046496 - DNA, 19 bp, Homo sapiens
gcctatgtcttcaaatcat

SEQ ID NO: 10046497 - DNA, 22 bp, Homo sapiens
caaaattagaaatgcagctgtt

SEQ ID NO: 10046498 - DNA, 22 bp, Homo sapiens
caaaattagggagtgagctgga

SEQ ID NO: 10046499 - DNA, 22 bp, Homo sapiens
caaacattcaagtacaagtctt

SEQ ID NO: 10046500 - DNA, 22 bp, Homo sapiens
attcaaattaagttaattcagc

SEQ ID NO: 10046501 - DNA, 22 bp, Homo sapiens
attaggaaactgaatgtcagaa

SEQ ID NO: 10046502 - DNA, 22 bp, Homo sapiens
attaggaaatgtgttgcaagca

SEQ ID NO: 10046503 - DNA, 22 bp, Homo sapiens
attaggaagaggatgtcagcat

SEQ ID NO: 10046504 - DNA, 22 bp, Homo sapiens
attaggatgtgtatattgtgtt

SEQ ID NO: 10046505 - DNA, 22 bp, Homo sapiens
attaggatgttcctatgcacat

SEQ ID NO: 10046506 - DNA, 22 bp, Homo sapiens
attaggacagagatgtcaagag

SEQ ID NO: 10046507 - DNA, 22 bp, Homo sapiens
attaggacacatacatgtacag

SEQ ID NO: 10046508 - DNA, 22 bp, Homo sapiens
attagtaaaacattgtatatgt

SEQ ID NO: 10046509 - DNA, 22 bp, Homo sapiens
attaggttagtgtgcaagagaa

SEQ ID NO: 10046510 - DNA, 17 bp, Homo sapiens
attaggttttgtcatga

SEQ ID NO: 10046511 - DNA, 22 bp, Homo sapiens
attaggttgtgctttgtggaca

SEQ ID NO: 10046512 - DNA, 22 bp, Homo sapiens
attaggcagggcatggtggctc

SEQ ID NO: 10046513 - DNA, 22 bp, Homo sapiens
attaggatttggtatggtcata

SEQ ID NO: 10046514 - DNA, 20 bp, Homo sapiens
attaggattttaggtcatca

SEQ ID NO: 10046515 - DNA, 22 bp, Homo sapiens
attaggcaattctgggcatctc

SEQ ID NO: 10046516 - DNA, 22 bp, Homo sapiens
attaggattttgtccaagtagc

SEQ ID NO: 10046517 - DNA, 22 bp, Homo sapiens
attagggaaggatttggcctga

SEQ ID NO: 10046518 - DNA, 22 bp, Homo sapiens
attaggtaagataaagcagagg

SEQ ID NO: 10046519 - DNA, 22 bp, Homo sapiens
gcacctttttctaggagaatgt

SEQ ID NO: 10046520 - DNA, 22 bp, Homo sapiens
gcacctttggaatgaaaagttg

SEQ ID NO: 10046521 - DNA, 22 bp, Homo sapiens
gcacctttctatattcagtggc

SEQ ID NO: 10046522 - DNA, 22 bp, Homo sapiens
attcacatgatgtatgtagggc

SEQ ID NO: 10046523 - DNA, 22 bp, Homo sapiens
gcacggctaatttttgtatttt

SEQ ID NO: 10046524 - DNA, 22 bp, Homo sapiens
attcagaatggcaaacttctag

SEQ ID NO: 10046525 - DNA, 22 bp, Homo sapiens
attcatatcatagagttattga

SEQ ID NO: 10046526 - DNA, 22 bp, Homo sapiens
attcatctgtacttcaatatct

SEQ ID NO: 10046527 - DNA, 23 bp, Homo sapiens
attgatgacttgattacactttt

SEQ ID NO: 10046528 - DNA, 22 bp, Homo sapiens
gctgttctctgtaacatgcatt

SEQ ID NO: 10046529 - DNA, 22 bp, Homo sapiens
cacaggaatcagcattaatggc

SEQ ID NO: 10046530 - DNA, 22 bp, Homo sapiens
cacagctttgctttccttaata

SEQ ID NO: 10046531 - DNA, 20 bp, Homo sapiens
ggccgaaataatagtggctt

SEQ ID NO: 10046532 - DNA, 22 bp, Homo sapiens
caccttttgtgtctgcgtttgt

SEQ ID NO: 10046533 - DNA, 22 bp, Homo sapiens
caccttgtgatcctcttgcctt

SEQ ID NO: 10046534 - DNA, 22 bp, Homo sapiens
caccttgtggcccagtcaggtt

SEQ ID NO: 10046535 - DNA, 22 bp, Homo sapiens
ggccaaatctgtaaggcaagat

SEQ ID NO: 10046536 - DNA, 22 bp, Homo sapiens
ggccaaaccgcaattatttttg

SEQ ID NO: 10046537 - DNA, 22 bp, Homo sapiens
ggccaaatgaaggcaatgggac

SEQ ID NO: 10046538 - DNA, 22 bp, Homo sapiens
ggccaaatgaaatctgagcaat

SEQ ID NO: 10046539 - DNA, 22 bp, Homo sapiens
ggccaaatttggccatgagcat

SEQ ID NO: 10046540 - DNA, 22 bp, Homo sapiens
cacattctttcacagttctgaa

SEQ ID NO: 10046541 - DNA, 23 bp, Homo sapiens
cacatatagcagccactaaggtc

SEQ ID NO: 10046542 - DNA, 22 bp, Homo sapiens
cacatatacctcttcttgagtt

SEQ ID NO: 10046543 - DNA, 22 bp, Homo sapiens
cagacctcagtcctcagtagga

SEQ ID NO: 10046544 - DNA, 22 bp, Homo sapiens
ggtctgagtggtgctgactcag

SEQ ID NO: 10046545 - DNA, 22 bp, Homo sapiens
ggtctgagtagagggctggcga

SEQ ID NO: 10046546 - DNA, 22 bp, Homo sapiens
ggtctgagtggggcctgagatt

SEQ ID NO: 10046547 - DNA, 22 bp, Homo sapiens
cagaggtacaagctaagttggg

SEQ ID NO: 10046548 - DNA, 22 bp, Homo sapiens
cagaggtacagccattgaagat

SEQ ID NO: 10046549 - DNA, 22 bp, Homo sapiens
cagaggtaccagcagcctctgg

SEQ ID NO: 10046550 - DNA, 22 bp, Homo sapiens
cagaggtagcatgctgtggctt

SEQ ID NO: 10046551 - DNA, 22 bp, Homo sapiens
cagaggtagaaggcatgcagtg

SEQ ID NO: 10046552 - DNA, 22 bp, Homo sapiens
cagaggtagaactggccctcac

SEQ ID NO: 10046553 - DNA, 22 bp, Homo sapiens
ggtcacagggaagggctctcaa

SEQ ID NO: 10046554 - DNA, 22 bp, Homo sapiens
ggtcacaggggagaagagtgat

SEQ ID NO: 10046555 - DNA, 22 bp, Homo sapiens
aggggaatgggtagactgttga

SEQ ID NO: 10046556 - DNA, 22 bp, Homo sapiens
cctcctggtgacaaggcaaagc

SEQ ID NO: 10046557 - DNA, 22 bp, Homo sapiens
cctcctttcctgttttcctgag

SEQ ID NO: 10046558 - DNA, 22 bp, Homo sapiens
cctcctggttgcaatgaaatgg

SEQ ID NO: 10046559 - DNA, 22 bp, Homo sapiens
cctcctggtgggcgcttctggc

SEQ ID NO: 10046560 - DNA, 22 bp, Homo sapiens
aggggctcaaagtgtgcaggga

SEQ ID NO: 10046561 - DNA, 22 bp, Homo sapiens
cccacgtcgaacttgctccaga

SEQ ID NO: 10046562 - DNA, 22 bp, Homo sapiens
cccagaggtgacatcccattct

SEQ ID NO: 10046563 - DNA, 22 bp, Homo sapiens
caggatgggatgtagtgggccc

SEQ ID NO: 10046564 - DNA, 19 bp, Homo sapiens
agcttccatattctctagt

SEQ ID NO: 10046565 - DNA, 22 bp, Homo sapiens
aggacactttgtggttgttgat

SEQ ID NO: 10046566 - DNA, 22 bp, Homo sapiens
aggacacttgagagtccagtca

SEQ ID NO: 10046567 - DNA, 22 bp, Homo sapiens
aggacacttaggttattcaact

SEQ ID NO: 10046568 - DNA, 22 bp, Homo sapiens
aggattttagataagacagcaa

SEQ ID NO: 10046569 - DNA, 21 bp, Homo sapiens
ccaccaggtcttctgctcggg

SEQ ID NO: 10046570 - DNA, 22 bp, Homo sapiens
ccacagagcattagatttcaga

SEQ ID NO: 10046571 - DNA, 22 bp, Homo sapiens
aggatttgaacctgcatccagt

SEQ ID NO: 10046572 - DNA, 20 bp, Homo sapiens
aggatttgagaaggcgtctt

SEQ ID NO: 10046573 - DNA, 22 bp, Homo sapiens
aggatttgtttataggtcttaa

SEQ ID NO: 10046574 - DNA, 22 bp, Homo sapiens
aggattttgacttattcaggga

SEQ ID NO: 10046575 - DNA, 22 bp, Homo sapiens
ctaagccactcaaatcttgtgg

SEQ ID NO: 10046576 - DNA, 22 bp, Homo sapiens
aggtttctggatttattatggc

SEQ ID NO: 10046577 - DNA, 22 bp, Homo sapiens
aggtttctggaaaggttttgct

SEQ ID NO: 10046578 - DNA, 22 bp, Homo sapiens
aggtttctttatgctgctagaa

SEQ ID NO: 10046579 - DNA, 22 bp, Homo sapiens
aggtttcttcttaggaatatgt

SEQ ID NO: 10046580 - DNA, 22 bp, Homo sapiens
aggtttctgctgtcctccttct

SEQ ID NO: 10046581 - DNA, 22 bp, Homo sapiens
aggtttctgcaatgtgtgtaca

SEQ ID NO: 10046582 - DNA, 22 bp, Homo sapiens
cctggattcaagtctttctttc

SEQ ID NO: 10046583 - DNA, 22 bp, Homo sapiens
ctctgcattttaacagatgatt

SEQ ID NO: 10046584 - DNA, 22 bp, Homo sapiens
ctctgcatgccttgctcagaca

SEQ ID NO: 10046585 - DNA, 22 bp, Homo sapiens
ctctgcctgtctcatcctgcaa

SEQ ID NO: 10046586 - DNA, 22 bp, Homo sapiens
agttagaatataattatgttaa

SEQ ID NO: 10046587 - DNA, 22 bp, Homo sapiens
agttataatctgctactgatat

SEQ ID NO: 10046588 - DNA, 22 bp, Homo sapiens
ctgaatgaggaaaagagtgagg

SEQ ID NO: 10046589 - DNA, 22 bp, Homo sapiens
ctcctggctctgccacttacta

SEQ ID NO: 10046590 - DNA, 22 bp, Homo sapiens
ctcctggctcgcccccagctga

SEQ ID NO: 10046591 - DNA, 22 bp, Homo sapiens
ctcctgggaatttagttgtgag

SEQ ID NO: 10046592 - DNA, 22 bp, Homo sapiens
ctcctggcttctgaaatcgtgg

SEQ ID NO: 10046593 - DNA, 22 bp, Homo sapiens
ctcctggctttcccagaccagg

SEQ ID NO: 10046594 - DNA, 22 bp, Homo sapiens
ctcattgcaacctccgcctccc

SEQ ID NO: 10046595 - DNA, 22 bp, Homo sapiens
agtccctgtactttccactgcc

SEQ ID NO: 10046596 - DNA, 22 bp, Homo sapiens
agtcttctcatttcacatgctt

SEQ ID NO: 10046597 - DNA, 22 bp, Homo sapiens
ctgcagagcaagtaacatcctc

SEQ ID NO: 10046598 - DNA, 22 bp, Homo sapiens
atcacattgccagtgattaccc

SEQ ID NO: 10046599 - DNA, 22 bp, Homo sapiens
atcacattgccagtgattaccc

SEQ ID NO: 10046600 - DNA, 22 bp, Homo sapiens
atcacattctttcaaagcagtc

SEQ ID NO: 10046601 - DNA, 22 bp, Homo sapiens
atattaggagttaaatgtatta

SEQ ID NO: 10046602 - DNA, 22 bp, Homo sapiens
atattaggttggtgcaaaagta

SEQ ID NO: 10046603 - DNA, 22 bp, Homo sapiens
atattagtttggagactacaat

SEQ ID NO: 10046604 - DNA, 23 bp, Homo sapiens
atattagggagattagccctcta

SEQ ID NO: 10046605 - DNA, 22 bp, Homo sapiens
atattaggcaaggagattattt

SEQ ID NO: 10046606 - DNA, 22 bp, Homo sapiens
atattaggtgctcaatacatgc

SEQ ID NO: 10046607 - DNA, 22 bp, Homo sapiens
atattagggtctctaaattcta

SEQ ID NO: 10046608 - DNA, 22 bp, Homo sapiens
cttcttatcaagtggcaaatct

SEQ ID NO: 10046609 - DNA, 22 bp, Homo sapiens
cttcctaaaagcttcaagagaa

SEQ ID NO: 10046610 - DNA, 22 bp, Homo sapiens
cttcccaagactgtattgcaag

SEQ ID NO: 10046611 - DNA, 22 bp, Homo sapiens
taatcacagaaacagactgttt

SEQ ID NO: 10046612 - DNA, 22 bp, Homo sapiens
taatcacaattcagatgtctta

SEQ ID NO: 10046613 - DNA, 22 bp, Homo sapiens
taataattggcaatgttgagca

SEQ ID NO: 10046614 - DNA, 22 bp, Homo sapiens
cagctcaagtttcccaggtcag

SEQ ID NO: 10046615 - DNA, 22 bp, Homo sapiens
cagctattggcaagaagtggtg

SEQ ID NO: 10046616 - DNA, 19 bp, Homo sapiens
taagtagtcaaatagtaac

SEQ ID NO: 10046617 - DNA, 22 bp, Homo sapiens
cagggtctgaaactgatcacag

SEQ ID NO: 10046618 - DNA, 22 bp, Homo sapiens
cagggtcatggcacctgcacgg

SEQ ID NO: 10046619 - DNA, 22 bp, Homo sapiens
tagcttaaaccaatctgaataa

SEQ ID NO: 10046620 - DNA, 22 bp, Homo sapiens
tagcttaaggagtaccagatca

SEQ ID NO: 10046621 - DNA, 22 bp, Homo sapiens
tagatttcgctgcatctcaatc

SEQ ID NO: 10046622 - DNA, 22 bp, Homo sapiens
tagatttcaggagacaaaatgg

SEQ ID NO: 10046623 - DNA, 22 bp, Homo sapiens
caggtgaagaggataaaaagtt

SEQ ID NO: 10046624 - DNA, 22 bp, Homo sapiens
tattagtgaaagaattagtttg

SEQ ID NO: 10046625 - DNA, 22 bp, Homo sapiens
tattataatttagggcttggat

SEQ ID NO: 10046626 - DNA, 22 bp, Homo sapiens
tattatgaggtatttggacttt

SEQ ID NO: 10046627 - DNA, 22 bp, Homo sapiens
tattattaaatggcagaatttt

SEQ ID NO: 10046628 - DNA, 22 bp, Homo sapiens
tattaggttggtgcaacagtaa

SEQ ID NO: 10046629 - DNA, 22 bp, Homo sapiens
tattaggtatgaactggcaacc

SEQ ID NO: 10046630 - DNA, 22 bp, Homo sapiens
tattaaatgttatttgggttgt

SEQ ID NO: 10046631 - DNA, 17 bp, Homo sapiens
cagtcacaggtcttttc

SEQ ID NO: 10046632 - DNA, 22 bp, Homo sapiens
cagtcacaagcgtacctaattt

SEQ ID NO: 10046633 - DNA, 22 bp, Homo sapiens
cagtcacacaagtggacttggg

SEQ ID NO: 10046634 - DNA, 22 bp, Homo sapiens
cagtcacattgccctgcattta

SEQ ID NO: 10046635 - DNA, 22 bp, Homo sapiens
ccactgtttttcagttaacttt

SEQ ID NO: 10046636 - DNA, 19 bp, Homo sapiens
tctaagcctcaatgttttc

SEQ ID NO: 10046637 - DNA, 22 bp, Homo sapiens
tctaagcctaggaaatgagttt

SEQ ID NO: 10046638 - DNA, 22 bp, Homo sapiens
tcctgggctttgtttctctcct

SEQ ID NO: 10046639 - DNA, 22 bp, Homo sapiens
tcctgggcttaagtgatcctcc

SEQ ID NO: 10046640 - DNA, 22 bp, Homo sapiens
cattaggacgccccgcccatac

SEQ ID NO: 10046641 - DNA, 19 bp, Homo sapiens
cattaggattagagacaag

SEQ ID NO: 10046642 - DNA, 22 bp, Homo sapiens
tccattttagaagaaaatccac

SEQ ID NO: 10046643 - DNA, 22 bp, Homo sapiens
tccattttcttgctctaggtaa

SEQ ID NO: 10046644 - DNA, 22 bp, Homo sapiens
tccattttgtaggtatgctaca

SEQ ID NO: 10046645 - DNA, 22 bp, Homo sapiens
tccatttttcatgactcctcaa

SEQ ID NO: 10046646 - DNA, 22 bp, Homo sapiens
tccattttcatctcatgtataa

SEQ ID NO: 10046647 - DNA, 22 bp, Homo sapiens
tccattttctaagtatcactta

SEQ ID NO: 10046648 - DNA, 22 bp, Homo sapiens
tccattttagagatgaagaaac

SEQ ID NO: 10046649 - DNA, 22 bp, Homo sapiens
cagtttttgccattaagagtaa

SEQ ID NO: 10046650 - DNA, 22 bp, Homo sapiens
tcagaggaggcatttaaacaga

SEQ ID NO: 10046651 - DNA, 22 bp, Homo sapiens
tcaatattcttctttagtagga

SEQ ID NO: 10046652 - DNA, 22 bp, Homo sapiens
tcagagaggttggtgataagaa

SEQ ID NO: 10046653 - DNA, 22 bp, Homo sapiens
tcagagagtgcaaaatatagct

SEQ ID NO: 10046654 - DNA, 22 bp, Homo sapiens
tcagtcacttttgcctgctaca

SEQ ID NO: 10046655 - DNA, 22 bp, Homo sapiens
tctggtaacctttatccctcct

SEQ ID NO: 10046656 - DNA, 22 bp, Homo sapiens
tgaggtatggtaaggtaaaatc

SEQ ID NO: 10046657 - DNA, 22 bp, Homo sapiens
tgagacgaagtcttgctctgtt

SEQ ID NO: 10046658 - DNA, 22 bp, Homo sapiens
tgaatgagtttggctgctgttc

SEQ ID NO: 10046659 - DNA, 18 bp, Homo sapiens
cccggctaatttttggta

SEQ ID NO: 10046660 - DNA, 22 bp, Homo sapiens
ccctctacagggaagcgctttc

SEQ ID NO: 10046661 - DNA, 23 bp, Homo sapiens
cccattttcatgttaactcctgg

SEQ ID NO: 10046662 - DNA, 22 bp, Homo sapiens
cccattcatcctcgcttccttc

SEQ ID NO: 10046663 - DNA, 22 bp, Homo sapiens
cctaggcccattaattcccctt

SEQ ID NO: 10046664 - DNA, 22 bp, Homo sapiens
cctcagaggttttcattctgta

SEQ ID NO: 10046665 - DNA, 22 bp, Homo sapiens
cctctgctctggtccatgtgct

SEQ ID NO: 10046666 - DNA, 22 bp, Homo sapiens
cctgagcctggctcatgcactc

SEQ ID NO: 10046667 - DNA, 22 bp, Homo sapiens
cctgagcctcttgcacgctcag

SEQ ID NO: 10046668 - DNA, 22 bp, Homo sapiens
ttagaatctaacattcttatct

SEQ ID NO: 10046669 - DNA, 19 bp, Homo sapiens
tggggctgtgttttgaccc

SEQ ID NO: 10046670 - DNA, 22 bp, Homo sapiens
tgttcatttggcccttttgtat

SEQ ID NO: 10046671 - DNA, 22 bp, Homo sapiens
tgttaatatactaaaatccact

SEQ ID NO: 10046672 - DNA, 22 bp, Homo sapiens
ctacctttctgactcttgggat

SEQ ID NO: 10046673 - DNA, 22 bp, Homo sapiens
ctacttctaagtacatggtgat

SEQ ID NO: 10046674 - DNA, 22 bp, Homo sapiens
ttcctggctgaactgaactcct

SEQ ID NO: 10046675 - DNA, 22 bp, Homo sapiens
ctatgagaagaaaacaagatta

SEQ ID NO: 10046676 - DNA, 23 bp, Homo sapiens
ctatggaataccaatgattctca

SEQ ID NO: 10046677 - DNA, 22 bp, Homo sapiens
ctattaggttggtgcaaaagta

SEQ ID NO: 10046678 - DNA, 22 bp, Homo sapiens
ctattaggtatgtggttgctat

SEQ ID NO: 10046679 - DNA, 22 bp, Homo sapiens
ctattaggtatgcagcctattt

SEQ ID NO: 10046680 - DNA, 22 bp, Homo sapiens
ctattaggcttccatttcatgc

SEQ ID NO: 10046681 - DNA, 22 bp, Homo sapiens
ttcagagggacattcaagggaa

SEQ ID NO: 10046682 - DNA, 22 bp, Homo sapiens
ttcagagggttttagggtcaga

SEQ ID NO: 10046683 - DNA, 22 bp, Homo sapiens
ttcaggatggcggatgttgggg

SEQ ID NO: 10046684 - DNA, 22 bp, Homo sapiens
ttcaggatgaaagtgtgcaaca

SEQ ID NO: 10046685 - DNA, 22 bp, Homo sapiens
ttcaggattctttcagactggg

SEQ ID NO: 10046686 - DNA, 22 bp, Homo sapiens
cgcatgagacctgccggccatc

SEQ ID NO: 10046687 - DNA, 22 bp, Homo sapiens
ttaggcattggaaggtcagctt

SEQ ID NO: 10046688 - DNA, 20 bp, Homo sapiens
ttaggcatttggattggctt

SEQ ID NO: 10046689 - DNA, 22 bp, Homo sapiens
ttaggcatatggcacatgatag

SEQ ID NO: 10046690 - DNA, 22 bp, Homo sapiens
ttaggatatgaaacagtataag

SEQ ID NO: 10046691 - DNA, 22 bp, Homo sapiens
ttaggatagtctgttagaaaag

SEQ ID NO: 10046692 - DNA, 22 bp, Homo sapiens
ttaggaatcacctgcagatctt

SEQ ID NO: 10046693 - DNA, 22 bp, Homo sapiens
ctcctggccctgagctcccagg

SEQ ID NO: 10046694 - DNA, 22 bp, Homo sapiens
ctcctggcactgtcttgaccca

SEQ ID NO: 10046695 - DNA, 17 bp, Homo sapiens
ctcctggcagcctcagg

SEQ ID NO: 10046696 - DNA, 17 bp, Homo sapiens
ctcctggccacccctct

SEQ ID NO: 10046697 - DNA, 23 bp, Homo sapiens
tttagtcagttgacagccatata

SEQ ID NO: 10046698 - DNA, 22 bp, Homo sapiens
tttagtcatttggatttgatct

SEQ ID NO: 10046699 - DNA, 22 bp, Homo sapiens
tttagtagaaatatttgggcct

SEQ ID NO: 10046700 - DNA, 22 bp, Homo sapiens
tttagtagatgcagcattattt

SEQ ID NO: 10046701 - DNA, 22 bp, Homo sapiens
tttagtagtgacagattctggg

SEQ ID NO: 10046702 - DNA, 22 bp, Homo sapiens
tttaggttaatcaacaaacatt

SEQ ID NO: 10046703 - DNA, 22 bp, Homo sapiens
ttgtggttaaccgcacattttt

SEQ ID NO: 10046704 - DNA, 21 bp, Homo sapiens
ctcttgtgtcagagccagagg

SEQ ID NO: 10046705 - DNA, 22 bp, Homo sapiens
ttttaatactgctattgtagga

SEQ ID NO: 10046706 - DNA, 22 bp, Homo sapiens
ttttagattataagtctaattc

SEQ ID NO: 10046707 - DNA, 22 bp, Homo sapiens
ttttagattgggaaatgtaaag

SEQ ID NO: 10046708 - DNA, 19 bp, Homo sapiens
ctgaggcccatgtaccatg

SEQ ID NO: 10046709 - DNA, 18 bp, Homo sapiens
ctgaggccaactacactg

SEQ ID NO: 10046710 - DNA, 21 bp, Homo sapiens
ctctttatatagtaaagatat

SEQ ID NO: 10046711 - DNA, 22 bp, Homo sapiens
ctgagccatgagcctgcgccca

SEQ ID NO: 10046712 - DNA, 22 bp, Homo sapiens
ctgagccatccataccagctta

SEQ ID NO: 10046713 - DNA, 22 bp, Homo sapiens
ctgagccagtagtcagggacaa

SEQ ID NO: 10046714 - DNA, 20 bp, Homo sapiens
ctgagccaactctcttcttg

SEQ ID NO: 10046715 - DNA, 22 bp, Homo sapiens
gaatagatcctcatttattgat

SEQ ID NO: 10046716 - DNA, 22 bp, Homo sapiens
gacagtaactgagagatgtaat

SEQ ID NO: 10046717 - DNA, 22 bp, Homo sapiens
gaccctgtttctacaaataatt

SEQ ID NO: 10046718 - DNA, 21 bp, Homo sapiens
gaacatttgggttgtttctac

SEQ ID NO: 10046719 - DNA, 22 bp, Homo sapiens
ctttcattcttagatattagtg

SEQ ID NO: 10046720 - DNA, 22 bp, Homo sapiens
gaaatatttctcttgagcccct

SEQ ID NO: 10046721 - DNA, 22 bp, Homo sapiens
gaacagctctgaagcagtaaat

SEQ ID NO: 10046722 - DNA, 22 bp, Homo sapiens
gaacagctataatcatctgtcc

SEQ ID NO: 10046723 - DNA, 22 bp, Homo sapiens
gaacagctgctagagatctgtg

SEQ ID NO: 10046724 - DNA, 22 bp, Homo sapiens
gaacagcttcttgggagctggg

SEQ ID NO: 10046725 - DNA, 22 bp, Homo sapiens
gagccaagatcgcaccactgca

SEQ ID NO: 10046726 - DNA, 22 bp, Homo sapiens
cttcctgggcaatgttctgctt

SEQ ID NO: 10046727 - DNA, 22 bp, Homo sapiens
cttgatctacatagtgaaaccc

SEQ ID NO: 10046728 - DNA, 16 bp, Homo sapiens
cttcctcttcactggc

SEQ ID NO: 10046729 - DNA, 22 bp, Homo sapiens
ctgtgccaggcccagctgactt

SEQ ID NO: 10046730 - DNA, 22 bp, Homo sapiens
ctgtgccagtgtattcctgtga

SEQ ID NO: 10046731 - DNA, 22 bp, Homo sapiens
ctgtgccatctgcactctcgtc

SEQ ID NO: 10046732 - DNA, 22 bp, Homo sapiens
ctgttaatctgcttgcatgatg

SEQ ID NO: 10046733 - DNA, 22 bp, Homo sapiens
ctggctcacctccgctccagca

SEQ ID NO: 10046734 - DNA, 19 bp, Homo sapiens
ctgggccagagctgtcctc

SEQ ID NO: 10046735 - DNA, 22 bp, Homo sapiens
ctgggccagaccttgtggtctt

SEQ ID NO: 10046736 - DNA, 22 bp, Homo sapiens
ctgggccaagaagttgtgtatg

SEQ ID NO: 10046737 - DNA, 22 bp, Homo sapiens
ctgggccaaaagaagtgttctt

SEQ ID NO: 10046738 - DNA, 19 bp, Homo sapiens
ctgggccagaatcagctca

SEQ ID NO: 10046739 - DNA, 22 bp, Homo sapiens
ctgggccacaagcctgtgtgat

SEQ ID NO: 10046740 - DNA, 22 bp, Homo sapiens
ctggctttctctgtggtgttca

SEQ ID NO: 10046741 - DNA, 20 bp, Homo sapiens
ggggctgcatgcagagaaga

SEQ ID NO: 10046742 - DNA, 22 bp, Homo sapiens
ggtcacgtgaccgcacctgcct

SEQ ID NO: 10046743 - DNA, 22 bp, Homo sapiens
ggtctaaaatgagtcttcctag

SEQ ID NO: 10046744 - DNA, 22 bp, Homo sapiens
ggtctgaaaatggtgaccacca

SEQ ID NO: 10046745 - DNA, 22 bp, Homo sapiens
ggtttgttggggtccaggccca

SEQ ID NO: 10046746 - DNA, 22 bp, Homo sapiens
gtacatttctcttgttcttatt

SEQ ID NO: 10046747 - DNA, 22 bp, Homo sapiens
gtattaggttggtgcaaaattg

SEQ ID NO: 10046748 - DNA, 22 bp, Homo sapiens
gtattaggttggtgcaaaagta

SEQ ID NO: 10046749 - DNA, 20 bp, Homo sapiens
gtattaggtgttcctctttc

SEQ ID NO: 10046750 - DNA, 20 bp, Homo sapiens
gtattaggaggtaaatgtaa

SEQ ID NO: 10046751 - DNA, 22 bp, Homo sapiens
gtattaggaggaacacaggcct

SEQ ID NO: 10046752 - DNA, 22 bp, Homo sapiens
gtattaggaaatatgaagaaag

SEQ ID NO: 10046753 - DNA, 22 bp, Homo sapiens
gtattaggtggtggaattgtag

SEQ ID NO: 10046754 - DNA, 22 bp, Homo sapiens
gtattagggccaaaggcaggaa

SEQ ID NO: 10046755 - DNA, 22 bp, Homo sapiens
gtattaggaggtggagcctttg

SEQ ID NO: 10046756 - DNA, 22 bp, Homo sapiens
gtgaaggactagcatggagggc

SEQ ID NO: 10046757 - DNA, 22 bp, Homo sapiens
ggctgaaggatgaaagctgcag

SEQ ID NO: 10046758 - DNA, 23 bp, Homo sapiens
ggagtgcaatggcgccatctcgg

SEQ ID NO: 10046759 - DNA, 22 bp, Homo sapiens
ggcaacattctccagatccttt

SEQ ID NO: 10046760 - DNA, 22 bp, Homo sapiens
ggcaagcataacctgtacagcc

SEQ ID NO: 10046761 - DNA, 23 bp, Homo sapiens
ggccacaaatagtctcccctggc

SEQ ID NO: 10046762 - DNA, 22 bp, Homo sapiens
ggccacaacttgctcctagccc

SEQ ID NO: 10046763 - DNA, 22 bp, Homo sapiens
ggccacaagtggtcctgagtcc

SEQ ID NO: 10046764 - DNA, 22 bp, Homo sapiens
gcagacattttgaatctaggct

SEQ ID NO: 10046765 - DNA, 22 bp, Homo sapiens
gcagaggtctcttcaaaataat

SEQ ID NO: 10046766 - DNA, 22 bp, Homo sapiens
gcagaggtctagcaccaagaat

SEQ ID NO: 10046767 - DNA, 20 bp, Homo sapiens
gcagcctcaacaggcacagc

SEQ ID NO: 10046768 - DNA, 22 bp, Homo sapiens
gctcccaactcaggcctcctcc

SEQ ID NO: 10046769 - DNA, 22 bp, Homo sapiens
gctcagagcttgaagttccact

SEQ ID NO: 10046770 - DNA, 22 bp, Homo sapiens
gctcctctattccccacatttt

SEQ ID NO: 10046771 - DNA, 22 bp, Homo sapiens
ggagacagggttgaaccacgca

SEQ ID NO: 10046772 - DNA, 22 bp, Homo sapiens
ggaagacagaagcctacagctt

SEQ ID NO: 10046773 - DNA, 22 bp, Homo sapiens
taattagagtttggtaaacaat

SEQ ID NO: 10046774 - DNA, 22 bp, Homo sapiens
taatagaatagtggaaacattg

SEQ ID NO: 10046775 - DNA, 22 bp, Homo sapiens
taatacatcattcatctaagga

SEQ ID NO: 10046776 - DNA, 22 bp, Homo sapiens
taataagtctgttgtttaattg

SEQ ID NO: 10046777 - DNA, 22 bp, Homo sapiens
tacagaaagggatgattgatct

SEQ ID NO: 10046778 - DNA, 22 bp, Homo sapiens
tacatagtattcacattgtttt

SEQ ID NO: 10046779 - DNA, 22 bp, Homo sapiens
tacatatactgagtgatttgct

SEQ ID NO: 10046780 - DNA, 23 bp, Homo sapiens
tacattctgtatttttatagagt

SEQ ID NO: 10046781 - DNA, 22 bp, Homo sapiens
tacattctggtggagaaagtaa

SEQ ID NO: 10046782 - DNA, 22 bp, Homo sapiens
tacattctatatctgttacatc

SEQ ID NO: 10046783 - DNA, 22 bp, Homo sapiens
tacattctgaaataaatggttt

SEQ ID NO: 10046784 - DNA, 22 bp, Homo sapiens
gttgatgaaaatgaattgcatg

SEQ ID NO: 10046785 - DNA, 22 bp, Homo sapiens
gtgctccctccttcctcaagga

SEQ ID NO: 10046786 - DNA, 22 bp, Homo sapiens
taacctttgttcaatgtaagat

SEQ ID NO: 10046787 - DNA, 22 bp, Homo sapiens
taacctttggtgaaatattaac

SEQ ID NO: 10046788 - DNA, 22 bp, Homo sapiens
taacctttcaggcatgtaggtt

SEQ ID NO: 10046789 - DNA, 22 bp, Homo sapiens
taaattagggactttagttaat

SEQ ID NO: 10046790 - DNA, 20 bp, Homo sapiens
taaattagccttgaagatta

SEQ ID NO: 10046791 - DNA, 22 bp, Homo sapiens
taaattatggctggcagagcag

SEQ ID NO: 10046792 - DNA, 22 bp, Homo sapiens
tattagcgcttactgagttgcc

SEQ ID NO: 10046793 - DNA, 22 bp, Homo sapiens
tattagatttgtttctgtagat

SEQ ID NO: 10046794 - DNA, 22 bp, Homo sapiens
tattagagaaaagatggatgtg

SEQ ID NO: 10046795 - DNA, 22 bp, Homo sapiens
tattagaggaaccaaggtggag

SEQ ID NO: 10046796 - DNA, 22 bp, Homo sapiens
tatttattctttgtactgcctt

SEQ ID NO: 10046797 - DNA, 22 bp, Homo sapiens
tatttattcattcagcaagcat

SEQ ID NO: 10046798 - DNA, 22 bp, Homo sapiens
tattattatagttattgggaag

SEQ ID NO: 10046799 - DNA, 22 bp, Homo sapiens
tattattatagttattgggaag

SEQ ID NO: 10046800 - DNA, 22 bp, Homo sapiens
tattaggtaaaggacttgcagg

SEQ ID NO: 10046801 - DNA, 20 bp, Homo sapiens
tattaggaaggaggaaggaa

SEQ ID NO: 10046802 - DNA, 22 bp, Homo sapiens
tattagggtaaatttgacatgc

SEQ ID NO: 10046803 - DNA, 23 bp, Homo sapiens
tattagggccaggactggcaaat

SEQ ID NO: 10046804 - DNA, 20 bp, Homo sapiens
tataaattcagagctttggt

SEQ ID NO: 10046805 - DNA, 22 bp, Homo sapiens
tataaatgcacttttgaaatat

SEQ ID NO: 10046806 - DNA, 22 bp, Homo sapiens
tataaattaatgtgcccatgag

SEQ ID NO: 10046807 - DNA, 22 bp, Homo sapiens
tatacaatggctgaatcatcca

SEQ ID NO: 10046808 - DNA, 21 bp, Homo sapiens
tatagtcacttgagcattatc

SEQ ID NO: 10046809 - DNA, 22 bp, Homo sapiens
tatatattcttaagtagtgtag

SEQ ID NO: 10046810 - DNA, 22 bp, Homo sapiens
tatatcaccaaaaacagttctg

SEQ ID NO: 10046811 - DNA, 22 bp, Homo sapiens
taggatttattctacaatattg

SEQ ID NO: 10046812 - DNA, 22 bp, Homo sapiens
taggatttggctttagtcaggt

SEQ ID NO: 10046813 - DNA, 22 bp, Homo sapiens
tagctttccttgttgcctgtgc

SEQ ID NO: 10046814 - DNA, 22 bp, Homo sapiens
taggatgatcttgtagagagat

SEQ ID NO: 10046815 - DNA, 22 bp, Homo sapiens
taggatgaggggtggccaagta

SEQ ID NO: 10046816 - DNA, 22 bp, Homo sapiens
taggatgacacagcaagtatag

SEQ ID NO: 10046817 - DNA, 22 bp, Homo sapiens
taggatttaggctttaacatct

SEQ ID NO: 10046818 - DNA, 22 bp, Homo sapiens
taggatttactttgacaatatt

SEQ ID NO: 10046819 - DNA, 22 bp, Homo sapiens
taggatgtagctatgtcatcat

SEQ ID NO: 10046820 - DNA, 22 bp, Homo sapiens
taggataggatggagacagaat

SEQ ID NO: 10046821 - DNA, 22 bp, Homo sapiens
taggatatggtagaaatcattc

SEQ ID NO: 10046822 - DNA, 22 bp, Homo sapiens
taggatatgtgaaatcatatta

SEQ ID NO: 10046823 - DNA, 22 bp, Homo sapiens
taggatctcaccatagaaggaa

SEQ ID NO: 10046824 - DNA, 22 bp, Homo sapiens
taggatgaaaatccagcttata

SEQ ID NO: 10046825 - DNA, 22 bp, Homo sapiens
tagaggtatttttgatggtcat

SEQ ID NO: 10046826 - DNA, 22 bp, Homo sapiens
tagaggtataccaaaaaggcat

SEQ ID NO: 10046827 - DNA, 22 bp, Homo sapiens
tagaggtagcaacaggactaga

SEQ ID NO: 10046828 - DNA, 22 bp, Homo sapiens
tagaggtagatggtcagccaat

SEQ ID NO: 10046829 - DNA, 22 bp, Homo sapiens
tagaggtagagttacattagtc

SEQ ID NO: 10046830 - DNA, 22 bp, Homo sapiens
tagaggtactcccctcaaagtt

SEQ ID NO: 10046831 - DNA, 22 bp, Homo sapiens
tactttttagcacagtgtgtgc

SEQ ID NO: 10046832 - DNA, 22 bp, Homo sapiens
tagaaatgattggttgagctct

SEQ ID NO: 10046833 - DNA, 19 bp, Homo sapiens
tccagaagtccctgagcgg

SEQ ID NO: 10046834 - DNA, 20 bp, Homo sapiens
tccagacatctagctcagtt

SEQ ID NO: 10046835 - DNA, 20 bp, Homo sapiens
tcccaaggatgcctgggtgt

SEQ ID NO: 10046836 - DNA, 19 bp, Homo sapiens
tcccaagatttctgtatca

SEQ ID NO: 10046837 - DNA, 22 bp, Homo sapiens
tcagaggaaagggaacatagtc

SEQ ID NO: 10046838 - DNA, 22 bp, Homo sapiens
tcacagtataacctcatatagg

SEQ ID NO: 10046839 - DNA, 21 bp, Homo sapiens
tcactagtgccttctgtcatt

SEQ ID NO: 10046840 - DNA, 20 bp, Homo sapiens
tcactagtaaccatctgctt

SEQ ID NO: 10046841 - DNA, 22 bp, Homo sapiens
tcacagtactccccaaagtttc

SEQ ID NO: 10046842 - DNA, 22 bp, Homo sapiens
tcagtctctggggcttctgttt

SEQ ID NO: 10046843 - DNA, 22 bp, Homo sapiens
tcatatatctgcaaagcagtat

SEQ ID NO: 10046844 - DNA, 22 bp, Homo sapiens
tcatataagtttaaaactatct

SEQ ID NO: 10046845 - DNA, 22 bp, Homo sapiens
tcatataagagctttagagtca

SEQ ID NO: 10046846 - DNA, 18 bp, Homo sapiens
tcattagggattgcaaag

SEQ ID NO: 10046847 - DNA, 22 bp, Homo sapiens
tttgtttagaaagagattggtg

SEQ ID NO: 10046848 - DNA, 22 bp, Homo sapiens
tttgtttagatggtaaatcagt

SEQ ID NO: 10046849 - DNA, 22 bp, Homo sapiens
ttttatatggcacattggttgg

SEQ ID NO: 10046850 - DNA, 22 bp, Homo sapiens
ttttatattgagtgagagttcc

SEQ ID NO: 10046851 - DNA, 22 bp, Homo sapiens
tttgtttactcattcattgatg

SEQ ID NO: 10046852 - DNA, 22 bp, Homo sapiens
ttttatcttcattcctatctac

SEQ ID NO: 10046853 - DNA, 22 bp, Homo sapiens
ttttatctgcttcattagttga

SEQ ID NO: 10046854 - DNA, 22 bp, Homo sapiens
ttttatctgcttcattagttga

SEQ ID NO: 10046855 - DNA, 22 bp, Homo sapiens
ttttatctgtgacatctggcag

SEQ ID NO: 10046856 - DNA, 22 bp, Homo sapiens
ttttatctacctatgctcattt

SEQ ID NO: 10046857 - DNA, 22 bp, Homo sapiens
tttttcatgagactagaagtca

SEQ ID NO: 10046858 - DNA, 22 bp, Homo sapiens
tttttgggtccaggctgtatct

SEQ ID NO: 10046859 - DNA, 22 bp, Homo sapiens
tttcattgcagagtctgtgtgc

SEQ ID NO: 10046860 - DNA, 22 bp, Homo sapiens
tttcattttggttatgccataa

SEQ ID NO: 10046861 - DNA, 22 bp, Homo sapiens
tttctaagtatcttgcagtttt

SEQ ID NO: 10046862 - DNA, 17 bp, Homo sapiens
tttctccttccatctca

SEQ ID NO: 10046863 - DNA, 22 bp, Homo sapiens
tttctctttgacaggaatcaga

SEQ ID NO: 10046864 - DNA, 22 bp, Homo sapiens
tttctggcagcgggacaggggt

SEQ ID NO: 10046865 - DNA, 22 bp, Homo sapiens
tttctgctgtgctttcttgcgt

SEQ ID NO: 10046866 - DNA, 22 bp, Homo sapiens
tttcttgtaagatgtttattaa

SEQ ID NO: 10046867 - DNA, 22 bp, Homo sapiens
tttcttctcgacaccttatccc

SEQ ID NO: 10046868 - DNA, 22 bp, Homo sapiens
ttggtttaggaactggcttgga

SEQ ID NO: 10046869 - DNA, 22 bp, Homo sapiens
ttggtttagagagtgtggttac

SEQ ID NO: 10046870 - DNA, 22 bp, Homo sapiens
ttggtttactaggattcaaatt

SEQ ID NO: 10046871 - DNA, 22 bp, Homo sapiens
ttgtgaatagtgccgctataaa

SEQ ID NO: 10046872 - DNA, 22 bp, Homo sapiens
tttattagattatcaaagaggt

SEQ ID NO: 10046873 - DNA, 22 bp, Homo sapiens
tttattatccagtgttgtcatg

SEQ ID NO: 10046874 - DNA, 22 bp, Homo sapiens
tttattagtgcttgtatcactg

SEQ ID NO: 10046875 - DNA, 22 bp, Homo sapiens
tttattatgtacaggcactata

SEQ ID NO: 10046876 - DNA, 22 bp, Homo sapiens
tttatttggcatctctgccaag

SEQ ID NO: 10046877 - DNA, 17 bp, Homo sapiens
tttataattggcctctt

SEQ ID NO: 10046878 - DNA, 22 bp, Homo sapiens
tttataagtactttgtctgctt

SEQ ID NO: 10046879 - DNA, 22 bp, Homo sapiens
tttataagaagcaatgtctgag

SEQ ID NO: 10046880 - DNA, 22 bp, Homo sapiens
tttatagggacagttcttggag

SEQ ID NO: 10046881 - DNA, 22 bp, Homo sapiens
tttattaatgtagcatccatgg

SEQ ID NO: 10046882 - DNA, 21 bp, Homo sapiens
tttattaacaactgtggacgt

SEQ ID NO: 10046883 - DNA, 22 bp, Homo sapiens
tttattaaaactgttggctctg

SEQ ID NO: 10046884 - DNA, 22 bp, Homo sapiens
tttacaacctcatattctgatg

SEQ ID NO: 10046885 - DNA, 22 bp, Homo sapiens
tttaattaggaaatgggcaggg

SEQ ID NO: 10046886 - DNA, 22 bp, Homo sapiens
ttccagagcagttttcagatca

SEQ ID NO: 10046887 - DNA, 22 bp, Homo sapiens
ttcatgtgaatatatttgtctt

SEQ ID NO: 10046888 - DNA, 22 bp, Homo sapiens
ttcatgtgatcacagattgtaa

SEQ ID NO: 10046889 - DNA, 22 bp, Homo sapiens
ttcatgtgtatggaacattttt

SEQ ID NO: 10046890 - DNA, 22 bp, Homo sapiens
ttcacagtggctgtgccatttg

SEQ ID NO: 10046891 - DNA, 22 bp, Homo sapiens
ttcacagtggctgacaggctgg

SEQ ID NO: 10046892 - DNA, 22 bp, Homo sapiens
ttcacagtggctaagttctgca

SEQ ID NO: 10046893 - DNA, 22 bp, Homo sapiens
ttcacagtggccctctctgagt

SEQ ID NO: 10046894 - DNA, 22 bp, Homo sapiens
ttcaattctgctctgatcttag

SEQ ID NO: 10046895 - DNA, 22 bp, Homo sapiens
ttcaattcaattctaaatatat

SEQ ID NO: 10046896 - DNA, 22 bp, Homo sapiens
ttcaattctaaactaatattct

SEQ ID NO: 10046897 - DNA, 22 bp, Homo sapiens
ttcacagtgagctatgtcttgt

SEQ ID NO: 10046898 - DNA, 22 bp, Homo sapiens
ttcacagtgctgcacctggctt

SEQ ID NO: 10046899 - DNA, 22 bp, Homo sapiens
ttcacagtcacccttctccatg

SEQ ID NO: 10046900 - DNA, 18 bp, Homo sapiens
ttcacaagggcttggttt

SEQ ID NO: 10046901 - DNA, 22 bp, Homo sapiens
ttcacaagtcattagctgcata

SEQ ID NO: 10046902 - DNA, 22 bp, Homo sapiens
ttgattaaacaggcatattcaa

SEQ ID NO: 10046903 - DNA, 22 bp, Homo sapiens
ttgatgtacagaattgttcaca

SEQ ID NO: 10046904 - DNA, 22 bp, Homo sapiens
ttgatcaagtgggaaatagtaa

SEQ ID NO: 10046905 - DNA, 22 bp, Homo sapiens
ttgaaggacatcctatttctag

SEQ ID NO: 10046906 - DNA, 22 bp, Homo sapiens
ttctttctcaacatgaatgttt

SEQ ID NO: 10046907 - DNA, 21 bp, Homo sapiens
ttctgagcactcatcactgtc

SEQ ID NO: 10046908 - DNA, 17 bp, Homo sapiens
ttctgagccacttcctt

SEQ ID NO: 10046909 - DNA, 22 bp, Homo sapiens
ttctgagcctcattcatgaggc

SEQ ID NO: 10046910 - DNA, 22 bp, Homo sapiens
ttctgagctacatagtactggg

SEQ ID NO: 10046911 - DNA, 22 bp, Homo sapiens
ttctagttttcagtccaccagg

SEQ ID NO: 10046912 - DNA, 22 bp, Homo sapiens
ttctagttgagggagacaaata

SEQ ID NO: 10046913 - DNA, 22 bp, Homo sapiens
tgtggtggggtctggtattcca

SEQ ID NO: 10046914 - DNA, 22 bp, Homo sapiens
tgtggtggctattctggtctca

SEQ ID NO: 10046915 - DNA, 22 bp, Homo sapiens
ttaacatgtcttgacttcatct

SEQ ID NO: 10046916 - DNA, 22 bp, Homo sapiens
ttaattagagctgatgttcata

SEQ ID NO: 10046917 - DNA, 22 bp, Homo sapiens
ttaattagtagaggcatttagt

SEQ ID NO: 10046918 - DNA, 22 bp, Homo sapiens
ttaataaacaggtgcagctgaa

SEQ ID NO: 10046919 - DNA, 18 bp, Homo sapiens
ttaaggataagcagacta

SEQ ID NO: 10046920 - DNA, 22 bp, Homo sapiens
ttaaatgagatgttcagatatt

SEQ ID NO: 10046921 - DNA, 22 bp, Homo sapiens
ttaaatattatgttgtctgcaa

SEQ ID NO: 10046922 - DNA, 22 bp, Homo sapiens
ttaaatattatgttgtctgcaa

SEQ ID NO: 10046923 - DNA, 22 bp, Homo sapiens
ttaaatattttcagcagggtca

SEQ ID NO: 10046924 - DNA, 22 bp, Homo sapiens
ttacacatgctttgtgtgtatg

SEQ ID NO: 10046925 - DNA, 22 bp, Homo sapiens
ttaattttaacctgtttgtgtc

SEQ ID NO: 10046926 - DNA, 22 bp, Homo sapiens
ttagaaagctttccatagtcaa

SEQ ID NO: 10046927 - DNA, 22 bp, Homo sapiens
ttagagagaaccatcaggatct

SEQ ID NO: 10046928 - DNA, 22 bp, Homo sapiens
ttagagatgtcccaaaatgaag

SEQ ID NO: 10046929 - DNA, 22 bp, Homo sapiens
ttactggctgggcctgagggct

SEQ ID NO: 10046930 - DNA, 21 bp, Homo sapiens
cttcccaaggcttcaaagcct

SEQ ID NO: 10046931 - DNA, 22 bp, Homo sapiens
cttagaaattgttactcattca

SEQ ID NO: 10046932 - DNA, 22 bp, Homo sapiens
cttagaaattgttactcattca

SEQ ID NO: 10046933 - DNA, 22 bp, Homo sapiens
atctgattcattgaaatgggtg

SEQ ID NO: 10046934 - DNA, 22 bp, Homo sapiens
atctctttgatggctcctgtga

SEQ ID NO: 10046935 - DNA, 23 bp, Homo sapiens
ctgtgggaagtcggggagcgcgc

SEQ ID NO: 10046936 - DNA, 22 bp, Homo sapiens
ctgtgggaatactgcgagtgta

SEQ ID NO: 10046937 - DNA, 22 bp, Homo sapiens
ctgtgggagaagctagcacagg

SEQ ID NO: 10046938 - DNA, 22 bp, Homo sapiens
atcagagacaaaaccagcactt

SEQ ID NO: 10046939 - DNA, 22 bp, Homo sapiens
atcagaattagccagtgaggct

SEQ ID NO: 10046940 - DNA, 22 bp, Homo sapiens
atccaggctgggtgtggctact

SEQ ID NO: 10046941 - DNA, 19 bp, Homo sapiens
atccaggtcatgtagttct

SEQ ID NO: 10046942 - DNA, 22 bp, Homo sapiens
ctgtgtgtcatttgtcaatcct

SEQ ID NO: 10046943 - DNA, 22 bp, Homo sapiens
ctgtgtgtcctcggacgagttt

SEQ ID NO: 10046944 - DNA, 22 bp, Homo sapiens
ctgggctcaagaagtcttccct

SEQ ID NO: 10046945 - DNA, 22 bp, Homo sapiens
ctggctgggagcgagctgctca

SEQ ID NO: 10046946 - DNA, 22 bp, Homo sapiens
ctggcttccatgctgtagtggc

SEQ ID NO: 10046947 - DNA, 22 bp, Homo sapiens
atcagaaaaacataatgttatt

SEQ ID NO: 10046948 - DNA, 22 bp, Homo sapiens
atcagaaactcttagagcaggg

SEQ ID NO: 10046949 - DNA, 21 bp, Homo sapiens
atcagaaaatgtaatggagca

SEQ ID NO: 10046950 - DNA, 22 bp, Homo sapiens
atcagaaatagtcatgttactt

SEQ ID NO: 10046951 - DNA, 22 bp, Homo sapiens
atcagaaaggtgggcaagcaga

SEQ ID NO: 10046952 - DNA, 22 bp, Homo sapiens
atcagaaactcttagagcaggg

SEQ ID NO: 10046953 - DNA, 22 bp, Homo sapiens
atcagaatagtgggggacagtc

SEQ ID NO: 10046954 - DNA, 21 bp, Homo sapiens
atcagaagttttggtcagtag

SEQ ID NO: 10046955 - DNA, 22 bp, Homo sapiens
atcagaaattgctaccagtgga

SEQ ID NO: 10046956 - DNA, 22 bp, Homo sapiens
atcagaagaaatggatgtgact

SEQ ID NO: 10046957 - DNA, 22 bp, Homo sapiens
atcagaaattgcccagctgttt

SEQ ID NO: 10046958 - DNA, 22 bp, Homo sapiens
atcagaagcttgtagtctctct

SEQ ID NO: 10046959 - DNA, 22 bp, Homo sapiens
atcaaagaatgtgactgaaata

SEQ ID NO: 10046960 - DNA, 23 bp, Homo sapiens
atcaaaggatgtagagaagaagc

SEQ ID NO: 10046961 - DNA, 20 bp, Homo sapiens
atcaaaggctgattcagtcc

SEQ ID NO: 10046962 - DNA, 22 bp, Homo sapiens
atattgatcttggaactgattt

SEQ ID NO: 10046963 - DNA, 22 bp, Homo sapiens
atattgtactagggttacatgt

SEQ ID NO: 10046964 - DNA, 22 bp, Homo sapiens
atatttaaacagggtaccaata

SEQ ID NO: 10046965 - DNA, 20 bp, Homo sapiens
ctgcagggtgagtgggcgat

SEQ ID NO: 10046966 - DNA, 20 bp, Homo sapiens
ctgcagggtgagtgggcgat

SEQ ID NO: 10046967 - DNA, 23 bp, Homo sapiens
ctgcagagaactgagggacagcc

SEQ ID NO: 10046968 - DNA, 22 bp, Homo sapiens
ctgcagagatgaagaaggtggc

SEQ ID NO: 10046969 - DNA, 22 bp, Homo sapiens
ctgcagagagtgccgggcagcc

SEQ ID NO: 10046970 - DNA, 22 bp, Homo sapiens
ctgcagagacctaggtcaggtt

SEQ ID NO: 10046971 - DNA, 22 bp, Homo sapiens
ctgcatgctgagccaacagtga

SEQ ID NO: 10046972 - DNA, 22 bp, Homo sapiens
agttatcaggtgttttcatgga

SEQ ID NO: 10046973 - DNA, 22 bp, Homo sapiens
ctgccctttgaaagaacgtctt

SEQ ID NO: 10046974 - DNA, 22 bp, Homo sapiens
ctgccctttatttcacaaagta

SEQ ID NO: 10046975 - DNA, 22 bp, Homo sapiens
ataacctggtagtattaaatgt

SEQ ID NO: 10046976 - DNA, 22 bp, Homo sapiens
ataacctgtttcagacatttgt

SEQ ID NO: 10046977 - DNA, 22 bp, Homo sapiens
ataacagatgtgaagtgctaat

SEQ ID NO: 10046978 - DNA, 22 bp, Homo sapiens
ataacagagagctactgaactg

SEQ ID NO: 10046979 - DNA, 22 bp, Homo sapiens
ataacagatactctctgtgagg

SEQ ID NO: 10046980 - DNA, 22 bp, Homo sapiens
ataagacacgccccactcactc

SEQ ID NO: 10046981 - DNA, 22 bp, Homo sapiens
ctgctgcaatctggcttccatg

SEQ ID NO: 10046982 - DNA, 22 bp, Homo sapiens
ctgctgaggtccttgctcagac

SEQ ID NO: 10046983 - DNA, 22 bp, Homo sapiens
ctgctgaggtccttgctcagac

SEQ ID NO: 10046984 - DNA, 22 bp, Homo sapiens
atagcagcatcagtttatctcc

SEQ ID NO: 10046985 - DNA, 22 bp, Homo sapiens
atagcagcatttcttccaagga

SEQ ID NO: 10046986 - DNA, 22 bp, Homo sapiens
atagcagcatttcttccaagga

SEQ ID NO: 10046987 - DNA, 22 bp, Homo sapiens
atagcagcatcagtttatctcc

SEQ ID NO: 10046988 - DNA, 19 bp, Homo sapiens
atagcagctatacccagat

SEQ ID NO: 10046989 - DNA, 19 bp, Homo sapiens
atagcagctatacccagat

SEQ ID NO: 10046990 - DNA, 22 bp, Homo sapiens
atagcagtaacactgacatttt

SEQ ID NO: 10046991 - DNA, 22 bp, Homo sapiens
ctggctggcaagtagaacacaa

SEQ ID NO: 10046992 - DNA, 22 bp, Homo sapiens
ctggctggccatgcagcgccag

SEQ ID NO: 10046993 - DNA, 22 bp, Homo sapiens
ctggctggccggagcgaggcgg

SEQ ID NO: 10046994 - DNA, 22 bp, Homo sapiens
ctggctggccatgcagcgccag

SEQ ID NO: 10046995 - DNA, 22 bp, Homo sapiens
atagcaaagatcacttccttga

SEQ ID NO: 10046996 - DNA, 22 bp, Homo sapiens
atagcaaactggagcttgcttt

SEQ ID NO: 10046997 - DNA, 22 bp, Homo sapiens
atagcaaactggcagcttgtgg

SEQ ID NO: 10046998 - DNA, 22 bp, Homo sapiens
atagcaaactggcagcttgtgg

SEQ ID NO: 10046999 - DNA, 22 bp, Homo sapiens
atagcaaaacccactgcattac

SEQ ID NO: 10047000 - DNA, 22 bp, Homo sapiens
atactacaatcataattgtaca

SEQ ID NO: 10047001 - DNA, 22 bp, Homo sapiens
atagcaaaaatgaacaaagctt

SEQ ID NO: 10047002 - DNA, 22 bp, Homo sapiens
atagatttgaatttaagacttg

SEQ ID NO: 10047003 - DNA, 22 bp, Homo sapiens
atactagactgttctgttatca

SEQ ID NO: 10047004 - DNA, 22 bp, Homo sapiens
ataccatttccatgttacatta

SEQ ID NO: 10047005 - DNA, 17 bp, Homo sapiens
atacattgttaaagtat

SEQ ID NO: 10047006 - DNA, 18 bp, Homo sapiens
ctgctgcaggcactcagg

SEQ ID NO: 10047007 - DNA, 22 bp, Homo sapiens
ctgctgcaggatgggcactctg

SEQ ID NO: 10047008 - DNA, 22 bp, Homo sapiens
ctgctgccaagggtgccacagg

SEQ ID NO: 10047009 - DNA, 22 bp, Homo sapiens
ctggaagagcatttgcataggg

SEQ ID NO: 10047010 - DNA, 22 bp, Homo sapiens
ctggagaagaggtagtatgtag

SEQ ID NO: 10047011 - DNA, 22 bp, Homo sapiens
ctggagacctctcctgagagtg

SEQ ID NO: 10047012 - DNA, 22 bp, Homo sapiens
agtcttctcatttcacatgctt

SEQ ID NO: 10047013 - DNA, 22 bp, Homo sapiens
agtcttctgaataagaatcact

SEQ ID NO: 10047014 - DNA, 22 bp, Homo sapiens
ctccagctgagtaagaacacta

SEQ ID NO: 10047015 - DNA, 22 bp, Homo sapiens
ctccagcttctgcccagagact

SEQ ID NO: 10047016 - DNA, 22 bp, Homo sapiens
agtcctggccccaaggaaggat

SEQ ID NO: 10047017 - DNA, 22 bp, Homo sapiens
ctcctggggcacttagaagcaa

SEQ ID NO: 10047018 - DNA, 22 bp, Homo sapiens
agtggcagagtgcactcaggca

SEQ ID NO: 10047019 - DNA, 22 bp, Homo sapiens
ctcctacattccaccttggact

SEQ ID NO: 10047020 - DNA, 22 bp, Homo sapiens
ctcctacagtgtttgagtccag

SEQ ID NO: 10047021 - DNA, 22 bp, Homo sapiens
ctccagggaaaggggcgtccgc

SEQ ID NO: 10047022 - DNA, 20 bp, Homo sapiens
ctccagggaacagactggag

SEQ ID NO: 10047023 - DNA, 22 bp, Homo sapiens
ctgaaattattgtttaatcaaa

SEQ ID NO: 10047024 - DNA, 22 bp, Homo sapiens
ctgacacactgagcatttgata

SEQ ID NO: 10047025 - DNA, 22 bp, Homo sapiens
agttagaatataattatgttaa

SEQ ID NO: 10047026 - DNA, 22 bp, Homo sapiens
agttagcagcttattagaaaca

SEQ ID NO: 10047027 - DNA, 22 bp, Homo sapiens
agttaagagtgtgaaaatgtta

SEQ ID NO: 10047028 - DNA, 22 bp, Homo sapiens
agttaactctgaaaagacattt

SEQ ID NO: 10047029 - DNA, 22 bp, Homo sapiens
ctgagcagcaccttcaagaaac

SEQ ID NO: 10047030 - DNA, 22 bp, Homo sapiens
ctgagcagcacagggcgccagg

SEQ ID NO: 10047031 - DNA, 22 bp, Homo sapiens
ctgagcagatgttgcccagaag

SEQ ID NO: 10047032 - DNA, 19 bp, Homo sapiens
ctgagcagagggaggaact

SEQ ID NO: 10047033 - DNA, 22 bp, Homo sapiens
ctctgctgagccagagtcccca

SEQ ID NO: 10047034 - DNA, 22 bp, Homo sapiens
ctctggggaagcagccagctgg

SEQ ID NO: 10047035 - DNA, 22 bp, Homo sapiens
ctgaaaggtataaataagactt

SEQ ID NO: 10047036 - DNA, 22 bp, Homo sapiens
ctgaaagggttacatagtaagt

SEQ ID NO: 10047037 - DNA, 22 bp, Homo sapiens
cctggagttttttggttgactc

SEQ ID NO: 10047038 - DNA, 23 bp, Homo sapiens
cctggagtactaaggggatggaa

SEQ ID NO: 10047039 - DNA, 22 bp, Homo sapiens
cctgcagagggagggccttatt

SEQ ID NO: 10047040 - DNA, 22 bp, Homo sapiens
cctgcagaggtcaggccagaaa

SEQ ID NO: 10047041 - DNA, 22 bp, Homo sapiens
aggtggggaggagtgtctcttt

SEQ ID NO: 10047042 - DNA, 22 bp, Homo sapiens
aggtggggaggagtgtctcttt

SEQ ID NO: 10047043 - DNA, 21 bp, Homo sapiens
aggtggggctgcacctctgct

SEQ ID NO: 10047044 - DNA, 22 bp, Homo sapiens
aggtggggcccaccaatttgca

SEQ ID NO: 10047045 - DNA, 22 bp, Homo sapiens
aggtggggagtatatgtaattg

SEQ ID NO: 10047046 - DNA, 22 bp, Homo sapiens
aggtggggaggagtgtctcttt

SEQ ID NO: 10047047 - DNA, 22 bp, Homo sapiens
aggtggggccaaatgctacagt

SEQ ID NO: 10047048 - DNA, 22 bp, Homo sapiens
aggtggggccaaatgctacagt

SEQ ID NO: 10047049 - DNA, 22 bp, Homo sapiens
cctgtgacattagaatttcatt

SEQ ID NO: 10047050 - DNA, 22 bp, Homo sapiens
cctgtcctccaagagcacatct

SEQ ID NO: 10047051 - DNA, 22 bp, Homo sapiens
agtaaaaagttcagaatggttg

SEQ ID NO: 10047052 - DNA, 22 bp, Homo sapiens
cctgttcattttttgactctgc

SEQ ID NO: 10047053 - DNA, 19 bp, Homo sapiens
cctgttcatgactctgtcc

SEQ ID NO: 10047054 - DNA, 22 bp, Homo sapiens
cctgttcagagctaagcatcat

SEQ ID NO: 10047055 - DNA, 22 bp, Homo sapiens
cctgttcactttgacttctcca

SEQ ID NO: 10047056 - DNA, 20 bp, Homo sapiens
cctgttcactgcgcagtttc

SEQ ID NO: 10047057 - DNA, 22 bp, Homo sapiens
cctgttcactgcacagtttccg

SEQ ID NO: 10047058 - DNA, 22 bp, Homo sapiens
cctgttcaccctccatgcacag

SEQ ID NO: 10047059 - DNA, 22 bp, Homo sapiens
cctgttcaccatggtcacgtgc

SEQ ID NO: 10047060 - DNA, 22 bp, Homo sapiens
cctgttcaagggatgattgacc

SEQ ID NO: 10047061 - DNA, 21 bp, Homo sapiens
cctgttcacagatctgtaact

SEQ ID NO: 10047062 - DNA, 22 bp, Homo sapiens
cctgttcaatattcttccttgt

SEQ ID NO: 10047063 - DNA, 22 bp, Homo sapiens
cctgttcaatgccctggcttca

SEQ ID NO: 10047064 - DNA, 22 bp, Homo sapiens
cgggctccgggtctttgcagtc

SEQ ID NO: 10047065 - DNA, 22 bp, Homo sapiens
cgggcaaggcgagactaggccc

SEQ ID NO: 10047066 - DNA, 17 bp, Homo sapiens
cgggcatggagggcagg

SEQ ID NO: 10047067 - DNA, 22 bp, Homo sapiens
agtacacacagtagaatagagt

SEQ ID NO: 10047068 - DNA, 22 bp, Homo sapiens
agtacacacagtagaatagagt

SEQ ID NO: 10047069 - DNA, 19 bp, Homo sapiens
agtacagaaaagagccctg

SEQ ID NO: 10047070 - DNA, 22 bp, Homo sapiens
agtatttagagacacaagatgg

SEQ ID NO: 10047071 - DNA, 22 bp, Homo sapiens
agtattcagcaaacgtgaacag

SEQ ID NO: 10047072 - DNA, 22 bp, Homo sapiens
ctacatttgttctatagctttt

SEQ ID NO: 10047073 - DNA, 22 bp, Homo sapiens
ctacatttgttcaaataagctg

SEQ ID NO: 10047074 - DNA, 22 bp, Homo sapiens
ctacattttgtgattatgaaat

SEQ ID NO: 10047075 - DNA, 22 bp, Homo sapiens
ctacattttaataagctgctta

SEQ ID NO: 10047076 - DNA, 22 bp, Homo sapiens
ctacatttcccagctgccttcc

SEQ ID NO: 10047077 - DNA, 22 bp, Homo sapiens
ctacccagatccaggatggcta

SEQ ID NO: 10047078 - DNA, 22 bp, Homo sapiens
agtccagggctctctgtgggat

SEQ ID NO: 10047079 - DNA, 22 bp, Homo sapiens
ctagaacagtcaaagtgagctc

SEQ ID NO: 10047080 - DNA, 22 bp, Homo sapiens
ctagaacagtcaaagtgagctc

SEQ ID NO: 10047081 - DNA, 22 bp, Homo sapiens
ctagtacaattttagcaagatg

SEQ ID NO: 10047082 - DNA, 22 bp, Homo sapiens
ctagtccactgtcctgcctcca

SEQ ID NO: 10047083 - DNA, 22 bp, Homo sapiens
ctagtccagtctcaaaatgcta

SEQ ID NO: 10047084 - DNA, 23 bp, Homo sapiens
aggatgtaggatgtatggcagag

SEQ ID NO: 10047085 - DNA, 22 bp, Homo sapiens
aggatgtctctccagcctggag

SEQ ID NO: 10047086 - DNA, 22 bp, Homo sapiens
catcttgtgaatttctgattct

SEQ ID NO: 10047087 - DNA, 22 bp, Homo sapiens
catcttgtgaggaccttcttgc

SEQ ID NO: 10047088 - DNA, 22 bp, Homo sapiens
catacaatcaagttctttatta

SEQ ID NO: 10047089 - DNA, 22 bp, Homo sapiens
aggaggcctggctggggagatc

SEQ ID NO: 10047090 - DNA, 20 bp, Homo sapiens
aggaggcctgcagatagttc

SEQ ID NO: 10047091 - DNA, 22 bp, Homo sapiens
catctcagtgtacagggagtct

SEQ ID NO: 10047092 - DNA, 22 bp, Homo sapiens
catctcatcagtgagagtcagc

SEQ ID NO: 10047093 - DNA, 22 bp, Homo sapiens
catccaagaaaattttctctct

SEQ ID NO: 10047094 - DNA, 22 bp, Homo sapiens
catctccaggagttctactcat

SEQ ID NO: 10047095 - DNA, 22 bp, Homo sapiens
aggaggcctacgcacatgtcta

SEQ ID NO: 10047096 - DNA, 22 bp, Homo sapiens
aggaggcctctatccagagaga

SEQ ID NO: 10047097 - DNA, 22 bp, Homo sapiens
cataagaatattccatcctttg

SEQ ID NO: 10047098 - DNA, 22 bp, Homo sapiens
cataagaaggtaacatccttaa

SEQ ID NO: 10047099 - DNA, 22 bp, Homo sapiens
cataatatactacattgatgaa

SEQ ID NO: 10047100 - DNA, 22 bp, Homo sapiens
cataacattaagcctctatttc

SEQ ID NO: 10047101 - DNA, 22 bp, Homo sapiens
cataacatgtacatataaatgc

SEQ ID NO: 10047102 - DNA, 22 bp, Homo sapiens
aggagccagtggagttcctgcc

SEQ ID NO: 10047103 - DNA, 22 bp, Homo sapiens
cagtccagctcatcagtggcac

SEQ ID NO: 10047104 - DNA, 22 bp, Homo sapiens
cagtccagccagtagggtgtgg

SEQ ID NO: 10047105 - DNA, 22 bp, Homo sapiens
cagtccaggttctttctctaaa

SEQ ID NO: 10047106 - DNA, 22 bp, Homo sapiens
aggagccaggccccatggggct

SEQ ID NO: 10047107 - DNA, 23 bp, Homo sapiens
ccacagagctgccaattcctgtg

SEQ ID NO: 10047108 - DNA, 23 bp, Homo sapiens
ccacaggcacagaggcttgcatc

SEQ ID NO: 10047109 - DNA, 22 bp, Homo sapiens
ccaatgatggtgcccacgatga

SEQ ID NO: 10047110 - DNA, 22 bp, Homo sapiens
ccacagagacagggtccttgct

SEQ ID NO: 10047111 - DNA, 19 bp, Homo sapiens
ccacagagactagaagaca

SEQ ID NO: 10047112 - DNA, 22 bp, Homo sapiens
ccacagagactctgcaggactg

SEQ ID NO: 10047113 - DNA, 22 bp, Homo sapiens
ccacagagactctgcaggactg

SEQ ID NO: 10047114 - DNA, 21 bp, Homo sapiens
ccaccaggtcttctgctcggg

SEQ ID NO: 10047115 - DNA, 20 bp, Homo sapiens
ccacagtggagactggagac

SEQ ID NO: 10047116 - DNA, 22 bp, Homo sapiens
ccactcagaccaacgacccttc

SEQ ID NO: 10047117 - DNA, 22 bp, Homo sapiens
ccacgagggaaccaggtggggt

SEQ ID NO: 10047118 - DNA, 22 bp, Homo sapiens
ccacccagccagatgcaggaag

SEQ ID NO: 10047119 - DNA, 22 bp, Homo sapiens
cattgcaggagagtaaataaaa

SEQ ID NO: 10047120 - DNA, 21 bp, Homo sapiens
aggcacttaaccaatgttagc

SEQ ID NO: 10047121 - DNA, 22 bp, Homo sapiens
aggcacttaataaggattcaat

SEQ ID NO: 10047122 - DNA, 22 bp, Homo sapiens
aggcacttgattaatgtgaatt

SEQ ID NO: 10047123 - DNA, 22 bp, Homo sapiens
catttcaagtaacagattgctt

SEQ ID NO: 10047124 - DNA, 22 bp, Homo sapiens
catttcaagcattgacttctat

SEQ ID NO: 10047125 - DNA, 22 bp, Homo sapiens
aggacacttaggttattcaact

SEQ ID NO: 10047126 - DNA, 22 bp, Homo sapiens
aggacacttgagagtccagtca

SEQ ID NO: 10047127 - DNA, 22 bp, Homo sapiens
aggacactttgtggttgttgat

SEQ ID NO: 10047128 - DNA, 22 bp, Homo sapiens
caggtgggccatgaaaaatgac

SEQ ID NO: 10047129 - DNA, 22 bp, Homo sapiens
caggtgggattttgctgcttga

SEQ ID NO: 10047130 - DNA, 22 bp, Homo sapiens
cagtaacatgaagagacatgga

SEQ ID NO: 10047131 - DNA, 22 bp, Homo sapiens
aggacagagggaccagagccca

SEQ ID NO: 10047132 - DNA, 22 bp, Homo sapiens
aggacagagggaccagagccca

SEQ ID NO: 10047133 - DNA, 22 bp, Homo sapiens
aggaagagcccgggtgacataa

SEQ ID NO: 10047134 - DNA, 22 bp, Homo sapiens
aggaagagcccgggtgacataa

SEQ ID NO: 10047135 - DNA, 22 bp, Homo sapiens
agctttggccctggaggttact

SEQ ID NO: 10047136 - DNA, 22 bp, Homo sapiens
agcttccattaactgctacact

SEQ ID NO: 10047137 - DNA, 22 bp, Homo sapiens
agctgtcagtgctgtgcctgta

SEQ ID NO: 10047138 - DNA, 22 bp, Homo sapiens
agctgtctctggtattatgtga

SEQ ID NO: 10047139 - DNA, 22 bp, Homo sapiens
agctgtatgcccaagatgctat

SEQ ID NO: 10047140 - DNA, 22 bp, Homo sapiens
agctggtttgcaagtataatca

SEQ ID NO: 10047141 - DNA, 22 bp, Homo sapiens
agctggttcattcattcatggt

SEQ ID NO: 10047142 - DNA, 22 bp, Homo sapiens
agctggtggagaagcagacctc

SEQ ID NO: 10047143 - DNA, 22 bp, Homo sapiens
caggcaggtcagtgaagaagga

SEQ ID NO: 10047144 - DNA, 22 bp, Homo sapiens
caggcagctcaaccttgggagc

SEQ ID NO: 10047145 - DNA, 22 bp, Homo sapiens
caggcagggagctggaaaggat

SEQ ID NO: 10047146 - DNA, 22 bp, Homo sapiens
caggcagggagctggaaaggat

SEQ ID NO: 10047147 - DNA, 22 bp, Homo sapiens
caggatggccccggggctgtgc

SEQ ID NO: 10047148 - DNA, 22 bp, Homo sapiens
caggcacaattatttccctttc

SEQ ID NO: 10047149 - DNA, 22 bp, Homo sapiens
caggatggtcagatgcattgtc

SEQ ID NO: 10047150 - DNA, 22 bp, Homo sapiens
caggatgggtgtcggccagcac

SEQ ID NO: 10047151 - DNA, 20 bp, Homo sapiens
caggcacactcattcctgct

SEQ ID NO: 10047152 - DNA, 22 bp, Homo sapiens
caggagcaaggagcagtgggat

SEQ ID NO: 10047153 - DNA, 22 bp, Homo sapiens
caggatggagagtgaggggtca

SEQ ID NO: 10047154 - DNA, 22 bp, Homo sapiens
caggatggcagagaaaagggtg

SEQ ID NO: 10047155 - DNA, 22 bp, Homo sapiens
caggatggagggagggctgtta

SEQ ID NO: 10047156 - DNA, 22 bp, Homo sapiens
caggactcacttctcacatccc

SEQ ID NO: 10047157 - DNA, 22 bp, Homo sapiens
caggactcttgtcatcatcagt

SEQ ID NO: 10047158 - DNA, 22 bp, Homo sapiens
caggactggctcgcagtgggtg

SEQ ID NO: 10047159 - DNA, 22 bp, Homo sapiens
cccacgtcgaacttgctccaga

SEQ ID NO: 10047160 - DNA, 22 bp, Homo sapiens
cccacgtcgaacttgctccaga

SEQ ID NO: 10047161 - DNA, 22 bp, Homo sapiens
aggctgccatagggaactgcat

SEQ ID NO: 10047162 - DNA, 22 bp, Homo sapiens
ccagtgtgattgttgcaagaat

SEQ ID NO: 10047163 - DNA, 20 bp, Homo sapiens
cccaaggtcacagctagcag

SEQ ID NO: 10047164 - DNA, 22 bp, Homo sapiens
cccaagtattcctcctctgccc

SEQ ID NO: 10047165 - DNA, 22 bp, Homo sapiens
cccacacaaatcatggggagaa

SEQ ID NO: 10047166 - DNA, 18 bp, Homo sapiens
cccacacagcagtagctc

SEQ ID NO: 10047167 - DNA, 20 bp, Homo sapiens
aggctctgcctgcaggccca

SEQ ID NO: 10047168 - DNA, 22 bp, Homo sapiens
aggctctgggaagcagtgagtt

SEQ ID NO: 10047169 - DNA, 22 bp, Homo sapiens
aggctctggtgcagctgtaact

SEQ ID NO: 10047170 - DNA, 22 bp, Homo sapiens
ccagccctgaaccctgctgcat

SEQ ID NO: 10047171 - DNA, 22 bp, Homo sapiens
ccagccagaagtccgggcttct

SEQ ID NO: 10047172 - DNA, 22 bp, Homo sapiens
ccagccagaagtccgggcttct

SEQ ID NO: 10047173 - DNA, 22 bp, Homo sapiens
ccagccaggcattgcaaactga

SEQ ID NO: 10047174 - DNA, 22 bp, Homo sapiens
ccagccaggctggctgtggagg

SEQ ID NO: 10047175 - DNA, 22 bp, Homo sapiens
ccagccaggctggctgtggagg

SEQ ID NO: 10047176 - DNA, 20 bp, Homo sapiens
ccagagctgatggctgcccg

SEQ ID NO: 10047177 - DNA, 21 bp, Homo sapiens
aggccctggaggtcagagaaa

SEQ ID NO: 10047178 - DNA, 22 bp, Homo sapiens
aggccctgctttccagagctca

SEQ ID NO: 10047179 - DNA, 22 bp, Homo sapiens
ccagctcccgcaggctgcacag

SEQ ID NO: 10047180 - DNA, 22 bp, Homo sapiens
ccaggcacaggtgggcctcaga

SEQ ID NO: 10047181 - DNA, 22 bp, Homo sapiens
aggctagaggcttctggcttca

SEQ ID NO: 10047182 - DNA, 22 bp, Homo sapiens
aggggctcagttactttggcag

SEQ ID NO: 10047183 - DNA, 18 bp, Homo sapiens
aggggcagcttgtgtgga

SEQ ID NO: 10047184 - DNA, 22 bp, Homo sapiens
aggggctgactggaaagtgcca

SEQ ID NO: 10047185 - DNA, 22 bp, Homo sapiens
aggggctcctttgtgctgcgtc

SEQ ID NO: 10047186 - DNA, 22 bp, Homo sapiens
agggggtcgtccggaagacctg

SEQ ID NO: 10047187 - DNA, 22 bp, Homo sapiens
aggggtcttgggagtcctggct

SEQ ID NO: 10047188 - DNA, 22 bp, Homo sapiens
aggggtctttaggaacgtcggg

SEQ ID NO: 10047189 - DNA, 22 bp, Homo sapiens
aggggtctatcctgagatggtc

SEQ ID NO: 10047190 - DNA, 20 bp, Homo sapiens
aggggtctagcagcagtgct

SEQ ID NO: 10047191 - DNA, 20 bp, Homo sapiens
ccccttcatctacagcctga

SEQ ID NO: 10047192 - DNA, 22 bp, Homo sapiens
ccccttcagagtagccacatta

SEQ ID NO: 10047193 - DNA, 22 bp, Homo sapiens
cccaggtgggttggcctctgtc

SEQ ID NO: 10047194 - DNA, 22 bp, Homo sapiens
agggacagtctactgttcactg

SEQ ID NO: 10047195 - DNA, 22 bp, Homo sapiens
agggagccctgaaccagagggt

SEQ ID NO: 10047196 - DNA, 22 bp, Homo sapiens
cccagagttggtcaggggaccc

SEQ ID NO: 10047197 - DNA, 22 bp, Homo sapiens
aggctttgttttatctcattta

SEQ ID NO: 10047198 - DNA, 22 bp, Homo sapiens
ggtcacagggaagggctctcaa

SEQ ID NO: 10047199 - DNA, 22 bp, Homo sapiens
ggtcagtgtatgtattgataag

SEQ ID NO: 10047200 - DNA, 22 bp, Homo sapiens
ggtctgagatatttgttcagct

SEQ ID NO: 10047201 - DNA, 22 bp, Homo sapiens
cagagtcttgtgtgttcagccc

SEQ ID NO: 10047202 - DNA, 22 bp, Homo sapiens
ggggagcaggctgggctgtctg

SEQ ID NO: 10047203 - DNA, 22 bp, Homo sapiens
cagaggcacagtgcgggccact

SEQ ID NO: 10047204 - DNA, 22 bp, Homo sapiens
cagagggctcggcggccgctcc

SEQ ID NO: 10047205 - DNA, 22 bp, Homo sapiens
cagagggctcggcggccgctcc

SEQ ID NO: 10047206 - DNA, 22 bp, Homo sapiens
cagagggctcttggctgcctgc

SEQ ID NO: 10047207 - DNA, 22 bp, Homo sapiens
cagagggcttcaggttcaggat

SEQ ID NO: 10047208 - DNA, 22 bp, Homo sapiens
cagagggcttcaggttcaggat

SEQ ID NO: 10047209 - DNA, 22 bp, Homo sapiens
cagaggggataacaggtgtaga

SEQ ID NO: 10047210 - DNA, 22 bp, Homo sapiens
cagaggggctgacacccttggc

SEQ ID NO: 10047211 - DNA, 21 bp, Homo sapiens
cagaggggctagcctggctgc

SEQ ID NO: 10047212 - DNA, 22 bp, Homo sapiens
ggtctgagcttgagcccatgct

SEQ ID NO: 10047213 - DNA, 22 bp, Homo sapiens
ggtctgaggctccaaggaggtg

SEQ ID NO: 10047214 - DNA, 22 bp, Homo sapiens
ggtctggaataaggtccaggaa

SEQ ID NO: 10047215 - DNA, 22 bp, Homo sapiens
ggtgacctcacctggtcccacc

SEQ ID NO: 10047216 - DNA, 19 bp, Homo sapiens
ggtgaccacctggtcagtg

SEQ ID NO: 10047217 - DNA, 22 bp, Homo sapiens
ggtgagactttagaagagccag

SEQ ID NO: 10047218 - DNA, 17 bp, Homo sapiens
ggtgagacctcccactc

SEQ ID NO: 10047219 - DNA, 22 bp, Homo sapiens
cagcacagtttcccccatgagc

SEQ ID NO: 10047220 - DNA, 22 bp, Homo sapiens
cagcacaattttcaggagtcca

SEQ ID NO: 10047221 - DNA, 23 bp, Homo sapiens
cagcacagtacatttcctgtctc

SEQ ID NO: 10047222 - DNA, 22 bp, Homo sapiens
cagagacagaaaatggatctag

SEQ ID NO: 10047223 - DNA, 22 bp, Homo sapiens
cagagacagcaagttgatttcc

SEQ ID NO: 10047224 - DNA, 22 bp, Homo sapiens
cagagacagcaagttgatttcc

SEQ ID NO: 10047225 - DNA, 22 bp, Homo sapiens
cagagacaggagtgctcccagt

SEQ ID NO: 10047226 - DNA, 22 bp, Homo sapiens
cagagacaggatctcgaagact

SEQ ID NO: 10047227 - DNA, 22 bp, Homo sapiens
cagagctgggtttgggaaacct

SEQ ID NO: 10047228 - DNA, 22 bp, Homo sapiens
cagagcctctgccctgggcact

SEQ ID NO: 10047229 - DNA, 22 bp, Homo sapiens
cagagcctctcagccccttggg

SEQ ID NO: 10047230 - DNA, 22 bp, Homo sapiens
cagagctggctctgcatgtaca

SEQ ID NO: 10047231 - DNA, 23 bp, Homo sapiens
cagagctggctcagagctgcctg

SEQ ID NO: 10047232 - DNA, 22 bp, Homo sapiens
cagagctgggatcccatgggcg

SEQ ID NO: 10047233 - DNA, 23 bp, Homo sapiens
cagagctggcttcatgggtgtgc

SEQ ID NO: 10047234 - DNA, 22 bp, Homo sapiens
cagagctgggcatggtgaaagg

SEQ ID NO: 10047235 - DNA, 20 bp, Homo sapiens
cagagctgggatttgaacac

SEQ ID NO: 10047236 - DNA, 22 bp, Homo sapiens
cagagctggggactgttggatg

SEQ ID NO: 10047237 - DNA, 19 bp, Homo sapiens
cagagcctcagagctagaa

SEQ ID NO: 10047238 - DNA, 22 bp, Homo sapiens
cagagcctcatcatccactcca

SEQ ID NO: 10047239 - DNA, 22 bp, Homo sapiens
cagagcctcagaatcctgtgga

SEQ ID NO: 10047240 - DNA, 22 bp, Homo sapiens
gggccacggaaggaccagtggg

SEQ ID NO: 10047241 - DNA, 22 bp, Homo sapiens
gggccagcagtatcggaggcat

SEQ ID NO: 10047242 - DNA, 22 bp, Homo sapiens
gtcccttcctcattccacttta

SEQ ID NO: 10047243 - DNA, 19 bp, Homo sapiens
gtcccttcactcctgctgg

SEQ ID NO: 10047244 - DNA, 22 bp, Homo sapiens
cagccagggtcaggcagcttct

SEQ ID NO: 10047245 - DNA, 22 bp, Homo sapiens
cagccccatggtgtgctccagc

SEQ ID NO: 10047246 - DNA, 22 bp, Homo sapiens
cagcaggaaggtttcccctgca

SEQ ID NO: 10047247 - DNA, 22 bp, Homo sapiens
cagcagcttttgcattctcatt

SEQ ID NO: 10047248 - DNA, 22 bp, Homo sapiens
cagcaggctctgagtggctgcc

SEQ ID NO: 10047249 - DNA, 22 bp, Homo sapiens
gtgctgaggtgggtgggcagcc

SEQ ID NO: 10047250 - DNA, 18 bp, Homo sapiens
gtgctgtgggcagtggcc

SEQ ID NO: 10047251 - DNA, 22 bp, Homo sapiens
cagcctctttccacatcaggca

SEQ ID NO: 10047252 - DNA, 22 bp, Homo sapiens
cagcctgcaggaggccgtcagc

SEQ ID NO: 10047253 - DNA, 22 bp, Homo sapiens
cagcctgcagggctgcctgttg

SEQ ID NO: 10047254 - DNA, 22 bp, Homo sapiens
cagccctgctcttagtgtctcc

SEQ ID NO: 10047255 - DNA, 22 bp, Homo sapiens
cagcctggagccacagcccagg

SEQ ID NO: 10047256 - DNA, 22 bp, Homo sapiens
cagcctgtctgggcagagtgga

SEQ ID NO: 10047257 - DNA, 22 bp, Homo sapiens
cacatttagaggttagcatggt

SEQ ID NO: 10047258 - DNA, 22 bp, Homo sapiens
ggaggtggaggttgcaatgagc

SEQ ID NO: 10047259 - DNA, 22 bp, Homo sapiens
cacataaatggtgccatgtttt

SEQ ID NO: 10047260 - DNA, 22 bp, Homo sapiens
ggcatcaggatctgtcttgctt

SEQ ID NO: 10047261 - DNA, 22 bp, Homo sapiens
ggcatcaggagcttcttcaggt

SEQ ID NO: 10047262 - DNA, 22 bp, Homo sapiens
cacctgttgtttattcatctct

SEQ ID NO: 10047263 - DNA, 22 bp, Homo sapiens
cacctgttcattacccatccca

SEQ ID NO: 10047264 - DNA, 22 bp, Homo sapiens
ggccccaggtagaagatataga

SEQ ID NO: 10047265 - DNA, 22 bp, Homo sapiens
ggccactgctgctctggtggag

SEQ ID NO: 10047266 - DNA, 22 bp, Homo sapiens
ggccactgtttcctgggcagtt

SEQ ID NO: 10047267 - DNA, 22 bp, Homo sapiens
ggccactgtcctctagcccaga

SEQ ID NO: 10047268 - DNA, 22 bp, Homo sapiens
ggccactgcctccgccatggct

SEQ ID NO: 10047269 - DNA, 22 bp, Homo sapiens
ggccactgcctccgccatggct

SEQ ID NO: 10047270 - DNA, 22 bp, Homo sapiens
ggctccagggtctctccttgtg

SEQ ID NO: 10047271 - DNA, 22 bp, Homo sapiens
ggcctgtgtcctccttgccctg

SEQ ID NO: 10047272 - DNA, 22 bp, Homo sapiens
cagaaacaggcaacgtgtgcac

SEQ ID NO: 10047273 - DNA, 22 bp, Homo sapiens
cagaaagccgacttacaatgga

SEQ ID NO: 10047274 - DNA, 22 bp, Homo sapiens
cagaaagccctatgtacagtgg

SEQ ID NO: 10047275 - DNA, 22 bp, Homo sapiens
cagaaagccaactccaactgtc

SEQ ID NO: 10047276 - DNA, 20 bp, Homo sapiens
cagaaagcatgttccagggc

SEQ ID NO: 10047277 - DNA, 22 bp, Homo sapiens
cagaaagcagagctgagccttt

SEQ ID NO: 10047278 - DNA, 22 bp, Homo sapiens
cactttaactcacatttcagct

SEQ ID NO: 10047279 - DNA, 23 bp, Homo sapiens
cagaaaacccagagctcagtccc

SEQ ID NO: 10047280 - DNA, 22 bp, Homo sapiens
ggctgttgacagacataggttt

SEQ ID NO: 10047281 - DNA, 22 bp, Homo sapiens
ggctgttcctctgagagctgat

SEQ ID NO: 10047282 - DNA, 22 bp, Homo sapiens
ggctggtgttgagtgcctgtag

SEQ ID NO: 10047283 - DNA, 21 bp, Homo sapiens
ggctggtgtttagctgtgata

SEQ ID NO: 10047284 - DNA, 21 bp, Homo sapiens
ggctggtgtttagctgtgata

SEQ ID NO: 10047285 - DNA, 22 bp, Homo sapiens
ggctggtgttacagtcggcagc

SEQ ID NO: 10047286 - DNA, 22 bp, Homo sapiens
cagaaagcttaggcaagttgga

SEQ ID NO: 10047287 - DNA, 22 bp, Homo sapiens
cacagcttgtttagtgactcac

SEQ ID NO: 10047288 - DNA, 22 bp, Homo sapiens
ggaggcagaatagagtgtgggt

SEQ ID NO: 10047289 - DNA, 22 bp, Homo sapiens
ggagcctgacagtgcccagcat

SEQ ID NO: 10047290 - DNA, 22 bp, Homo sapiens
ggagcctgagcggcccagggcc

SEQ ID NO: 10047291 - DNA, 22 bp, Homo sapiens
ggagcctgcgggagctcccatt

SEQ ID NO: 10047292 - DNA, 22 bp, Homo sapiens
cacagagagctacgtgcagcgt

SEQ ID NO: 10047293 - DNA, 22 bp, Homo sapiens
cacagagctcaagtcttagaaa

SEQ ID NO: 10047294 - DNA, 22 bp, Homo sapiens
cacagagaaaatgttggtgctt

SEQ ID NO: 10047295 - DNA, 22 bp, Homo sapiens
ggactggggccaacacctccct

SEQ ID NO: 10047296 - DNA, 22 bp, Homo sapiens
ggactgggagaatggaggcaag

SEQ ID NO: 10047297 - DNA, 22 bp, Homo sapiens
cacagaactggttaatagcaga

SEQ ID NO: 10047298 - DNA, 21 bp, Homo sapiens
ggaagggctctgaggacggct

SEQ ID NO: 10047299 - DNA, 22 bp, Homo sapiens
ggaaggggagctggaaagggta

SEQ ID NO: 10047300 - DNA, 22 bp, Homo sapiens
cacacagatggtaagggaggga

SEQ ID NO: 10047301 - DNA, 22 bp, Homo sapiens
cacacagctagtgacaggagaa

SEQ ID NO: 10047302 - DNA, 22 bp, Homo sapiens
cacacagctcaggggcactgcc

SEQ ID NO: 10047303 - DNA, 22 bp, Homo sapiens
cacacagcaacaagaatagcca

SEQ ID NO: 10047304 - DNA, 22 bp, Homo sapiens
cacacagctagtgacaggagaa

SEQ ID NO: 10047305 - DNA, 21 bp, Homo sapiens
cacacagctgcccttaggtag

SEQ ID NO: 10047306 - DNA, 22 bp, Homo sapiens
gctgttctctgtaacatgcatt

SEQ ID NO: 10047307 - DNA, 20 bp, Homo sapiens
gctgttctgaagcagaaggc

SEQ ID NO: 10047308 - DNA, 22 bp, Homo sapiens
gctgttctaggagctgtgagca

SEQ ID NO: 10047309 - DNA, 22 bp, Homo sapiens
gctgttctagcttcagtttcgc

SEQ ID NO: 10047310 - DNA, 19 bp, Homo sapiens
gctgttctgaccatcaccc

SEQ ID NO: 10047311 - DNA, 22 bp, Homo sapiens
gctgttctgcaccagacttcag

SEQ ID NO: 10047312 - DNA, 22 bp, Homo sapiens
gctgttctgtccccatgggtaa

SEQ ID NO: 10047313 - DNA, 22 bp, Homo sapiens
gctgttctgcgtcccaggctgg

SEQ ID NO: 10047314 - DNA, 22 bp, Homo sapiens
gctgttctttggtcaaaggtat

SEQ ID NO: 10047315 - DNA, 18 bp, Homo sapiens
gctgttcttcgcactggc

SEQ ID NO: 10047316 - DNA, 21 bp, Homo sapiens
gctgttctttcagctggtctt

SEQ ID NO: 10047317 - DNA, 22 bp, Homo sapiens
gctgttctttgcatctctggtg

SEQ ID NO: 10047318 - DNA, 22 bp, Homo sapiens
gctgttcattagaaatagaatg

SEQ ID NO: 10047319 - DNA, 22 bp, Homo sapiens
gctgttcccttgtgcctctgtc

SEQ ID NO: 10047320 - DNA, 22 bp, Homo sapiens
caaggtgccatgctgggcgggg

SEQ ID NO: 10047321 - DNA, 22 bp, Homo sapiens
caaggtcacataacttgtcaaa

SEQ ID NO: 10047322 - DNA, 20 bp, Homo sapiens
caagggtttgcattggcttt

SEQ ID NO: 10047323 - DNA, 22 bp, Homo sapiens
caagtacaaaatgatatttagt

SEQ ID NO: 10047324 - DNA, 22 bp, Homo sapiens
caagtaatggttttataatagt

SEQ ID NO: 10047325 - DNA, 22 bp, Homo sapiens
caatgttccctgtactgctttt

SEQ ID NO: 10047326 - DNA, 22 bp, Homo sapiens
gctttgaagacttttccagggt

SEQ ID NO: 10047327 - DNA, 22 bp, Homo sapiens
caaatgtaaattcttttgaagc

SEQ ID NO: 10047328 - DNA, 22 bp, Homo sapiens
caaatgtaatggcaggttttgc

SEQ ID NO: 10047329 - DNA, 22 bp, Homo sapiens
caaatgtaattgcggtttttgc

SEQ ID NO: 10047330 - DNA, 22 bp, Homo sapiens
caaatgtaattgcggtttttgc

SEQ ID NO: 10047331 - DNA, 22 bp, Homo sapiens
caaatgtataaatgtactttct

SEQ ID NO: 10047332 - DNA, 22 bp, Homo sapiens
caagccagtgacagccagggaa

SEQ ID NO: 10047333 - DNA, 23 bp, Homo sapiens
attgatgacttgattacactttt

SEQ ID NO: 10047334 - DNA, 22 bp, Homo sapiens
attgatgagcattactctctaa

SEQ ID NO: 10047335 - DNA, 18 bp, Homo sapiens
gcagggctgcacacgcat

SEQ ID NO: 10047336 - DNA, 22 bp, Homo sapiens
gcagctggacccacacggctta

SEQ ID NO: 10047337 - DNA, 22 bp, Homo sapiens
attctttagccagcaggtatat

SEQ ID NO: 10047338 - DNA, 19 bp, Homo sapiens
attcttgttaagtgtcatc

SEQ ID NO: 10047339 - DNA, 22 bp, Homo sapiens
attcttgtttaatttgcatccc

SEQ ID NO: 10047340 - DNA, 22 bp, Homo sapiens
attctttaattcaattgaagga

SEQ ID NO: 10047341 - DNA, 22 bp, Homo sapiens
attctttacattggcttcttcc

SEQ ID NO: 10047342 - DNA, 22 bp, Homo sapiens
attgtctttccactgagaagtt

SEQ ID NO: 10047343 - DNA, 22 bp, Homo sapiens
attgtctttggtgcttccagga

SEQ ID NO: 10047344 - DNA, 20 bp, Homo sapiens
gccaacgcgctggggctgcc

SEQ ID NO: 10047345 - DNA, 22 bp, Homo sapiens
gccaaatttgtgagcccccaag

SEQ ID NO: 10047346 - DNA, 22 bp, Homo sapiens
gccaagcactgaggacattgtt

SEQ ID NO: 10047347 - DNA, 23 bp, Homo sapiens
gcagtgcttggcacagctgggtc

SEQ ID NO: 10047348 - DNA, 20 bp, Homo sapiens
gcagtgctggtgcctctgct

SEQ ID NO: 10047349 - DNA, 22 bp, Homo sapiens
gcagtgtgtggtgagggctgcc

SEQ ID NO: 10047350 - DNA, 22 bp, Homo sapiens
gcatcagaatcatccggggaat

SEQ ID NO: 10047351 - DNA, 22 bp, Homo sapiens
attcataacggcaaatgtcacc

SEQ ID NO: 10047352 - DNA, 22 bp, Homo sapiens
attcagtttcatggcacagcta

SEQ ID NO: 10047353 - DNA, 22 bp, Homo sapiens
gcagcagagtagacagagccct

SEQ ID NO: 10047354 - DNA, 22 bp, Homo sapiens
gcagcagatgctttcatggaca

SEQ ID NO: 10047355 - DNA, 22 bp, Homo sapiens
gcagcagagtttgggagatggt

SEQ ID NO: 10047356 - DNA, 20 bp, Homo sapiens
attcagaataggcatgtaaa

SEQ ID NO: 10047357 - DNA, 22 bp, Homo sapiens
attcagaatggcaaacttctag

SEQ ID NO: 10047358 - DNA, 22 bp, Homo sapiens
attcagaagctattcttagttc

SEQ ID NO: 10047359 - DNA, 22 bp, Homo sapiens
attcagactcttgagcagtccc

SEQ ID NO: 10047360 - DNA, 22 bp, Homo sapiens
attcagaattttggggagctaa

SEQ ID NO: 10047361 - DNA, 22 bp, Homo sapiens
attcagactatgaacacgtcag

SEQ ID NO: 10047362 - DNA, 23 bp, Homo sapiens
attcagaattgtgtgtttgtata

SEQ ID NO: 10047363 - DNA, 22 bp, Homo sapiens
attcagaattgtgggcagtaca

SEQ ID NO: 10047364 - DNA, 22 bp, Homo sapiens
gcagcagagaccccaggaagga

SEQ ID NO: 10047365 - DNA, 22 bp, Homo sapiens
gcagcagagaacacaatgatgg

SEQ ID NO: 10047366 - DNA, 22 bp, Homo sapiens
gcagcagagctttgtcctggct

SEQ ID NO: 10047367 - DNA, 22 bp, Homo sapiens
gcagcagaggccctactctttg

SEQ ID NO: 10047368 - DNA, 21 bp, Homo sapiens
gcagcagaggcttgacagaca

SEQ ID NO: 10047369 - DNA, 22 bp, Homo sapiens
gcagcagagtagacagagccct

SEQ ID NO: 10047370 - DNA, 22 bp, Homo sapiens
attcaagctgaatggtgacaga

SEQ ID NO: 10047371 - DNA, 22 bp, Homo sapiens
attcaagattaattctatgtca

SEQ ID NO: 10047372 - DNA, 22 bp, Homo sapiens
attcagaaactctgggcagaac

SEQ ID NO: 10047373 - DNA, 22 bp, Homo sapiens
attcagaaagatatgcctggtt

SEQ ID NO: 10047374 - DNA, 22 bp, Homo sapiens
attcagaaagcaagtgctgggt

SEQ ID NO: 10047375 - DNA, 22 bp, Homo sapiens
attcagaaagttgtcatatttg

SEQ ID NO: 10047376 - DNA, 22 bp, Homo sapiens
attcagaaagggttgcctggtt

SEQ ID NO: 10047377 - DNA, 22 bp, Homo sapiens
attcaaattaagttaattcagc

SEQ ID NO: 10047378 - DNA, 22 bp, Homo sapiens
attacagtgggtaaacagaatt

SEQ ID NO: 10047379 - DNA, 22 bp, Homo sapiens
attacatgagagaatgtaaata

SEQ ID NO: 10047380 - DNA, 22 bp, Homo sapiens
attacatatgttggcaacattt

SEQ ID NO: 10047381 - DNA, 22 bp, Homo sapiens
attacatatgttggcaacattt

SEQ ID NO: 10047382 - DNA, 18 bp, Homo sapiens
caaagcaggtgacagtgt

SEQ ID NO: 10047383 - DNA, 22 bp, Homo sapiens
caaagcagtgatccttaaagga

SEQ ID NO: 10047384 - DNA, 20 bp, Homo sapiens
caaagcagtaggataaaaat

SEQ ID NO: 10047385 - DNA, 22 bp, Homo sapiens
caaaattgatgaatgtatgatt

SEQ ID NO: 10047386 - DNA, 22 bp, Homo sapiens
caaaattgatgaatgtatgatt

SEQ ID NO: 10047387 - DNA, 22 bp, Homo sapiens
caaaattgttgatgctgctttg

SEQ ID NO: 10047388 - DNA, 22 bp, Homo sapiens
caaaagcagttctatctgagtt

SEQ ID NO: 10047389 - DNA, 19 bp, Homo sapiens
atttttcttcctctgtgca

SEQ ID NO: 10047390 - DNA, 22 bp, Homo sapiens
atttttctctcacacttaccag

SEQ ID NO: 10047391 - DNA, 22 bp, Homo sapiens
atttttctctccactccattaa

SEQ ID NO: 10047392 - DNA, 22 bp, Homo sapiens
caaatgctactaataggcaagt

SEQ ID NO: 10047393 - DNA, 22 bp, Homo sapiens
caaatgctaacttctttccaaa

SEQ ID NO: 10047394 - DNA, 22 bp, Homo sapiens
caaatgcatgagaaataagagg

SEQ ID NO: 10047395 - DNA, 22 bp, Homo sapiens
caaatgcatagtttataagaag

SEQ ID NO: 10047396 - DNA, 20 bp, Homo sapiens
gctgactgtttgggtggcgg

SEQ ID NO: 10047397 - DNA, 22 bp, Homo sapiens
gctgactgatggacacagcacc

SEQ ID NO: 10047398 - DNA, 22 bp, Homo sapiens
gctgactgctcagggccagctg

SEQ ID NO: 10047399 - DNA, 22 bp, Homo sapiens
gctgactggttgcacagagggt

SEQ ID NO: 10047400 - DNA, 22 bp, Homo sapiens
caaatactgggtaagttaattt

SEQ ID NO: 10047401 - DNA, 22 bp, Homo sapiens
caaatagaactcacagacaaga

SEQ ID NO: 10047402 - DNA, 22 bp, Homo sapiens
caaagctggactgctcagttca

SEQ ID NO: 10047403 - DNA, 22 bp, Homo sapiens
caaagctgtgaattcctacaaa

SEQ ID NO: 10047404 - DNA, 22 bp, Homo sapiens
caaaggaaatactaatctggaa

SEQ ID NO: 10047405 - DNA, 22 bp, Homo sapiens
caaagctgacgaggtcagcatc

SEQ ID NO: 10047406 - DNA, 22 bp, Homo sapiens
caaagtgctggaattacaggtg

SEQ ID NO: 10047407 - DNA, 22 bp, Homo sapiens
caaataattactatcctcactt

SEQ ID NO: 10047408 - DNA, 22 bp, Homo sapiens
caaatactaaacataagatttt

SEQ ID NO: 10047409 - DNA, 22 bp, Homo sapiens
gcctgaagaacagctgtgagga

SEQ ID NO: 10047410 - DNA, 19 bp, Homo sapiens
gcctctgagggcaggacac

SEQ ID NO: 10047411 - DNA, 22 bp, Homo sapiens
gcccccagagaatgaggtacga

SEQ ID NO: 10047412 - DNA, 22 bp, Homo sapiens
gcctggattccttgtttctcag

SEQ ID NO: 10047413 - DNA, 22 bp, Homo sapiens
gcctggagttgtggtgaagcca

SEQ ID NO: 10047414 - DNA, 22 bp, Homo sapiens
gcctgaagtttcatgcctctat

SEQ ID NO: 10047415 - DNA, 22 bp, Homo sapiens
gccccaggttgcctgtcccagg

SEQ ID NO: 10047416 - DNA, 22 bp, Homo sapiens
atttctggctgttggaaagttc

SEQ ID NO: 10047417 - DNA, 22 bp, Homo sapiens
atttccatgaaggcagatttta

SEQ ID NO: 10047418 - DNA, 17 bp, Homo sapiens
gcccacccttaggagct

SEQ ID NO: 10047419 - DNA, 17 bp, Homo sapiens
gcccacccttaggagct

SEQ ID NO: 10047420 - DNA, 23 bp, Homo sapiens
atgtccccttcttgatgcctggc

SEQ ID NO: 10047421 - DNA, 22 bp, Homo sapiens
atgtcctcggctctgtgctgct

SEQ ID NO: 10047422 - DNA, 22 bp, Homo sapiens
atgtccttttatttaaagcagg

SEQ ID NO: 10047423 - DNA, 22 bp, Homo sapiens
gaggtggatgttgcagtgagct

SEQ ID NO: 10047424 - DNA, 22 bp, Homo sapiens
atgtgaaagaggtgttcagtgg

SEQ ID NO: 10047425 - DNA, 22 bp, Homo sapiens
atgtgaaatattaagccgagga

SEQ ID NO: 10047426 - DNA, 21 bp, Homo sapiens
atgtgaaatatcatcagagca

SEQ ID NO: 10047427 - DNA, 22 bp, Homo sapiens
atgtgaaatagctggatatgaa

SEQ ID NO: 10047428 - DNA, 22 bp, Homo sapiens
atgttctgtttcttaatcttga

SEQ ID NO: 10047429 - DNA, 20 bp, Homo sapiens
atgttctgtggctgtcatgg

SEQ ID NO: 10047430 - DNA, 22 bp, Homo sapiens
atgttctgaatcaagcaactct

SEQ ID NO: 10047431 - DNA, 19 bp, Homo sapiens
atgttctgaattactgtaa

SEQ ID NO: 10047432 - DNA, 22 bp, Homo sapiens
atgttctgcctccattttgagt

SEQ ID NO: 10047433 - DNA, 22 bp, Homo sapiens
atgttctgaataatgtgcatta

SEQ ID NO: 10047434 - DNA, 22 bp, Homo sapiens
atgttctgttttgtaattcata

SEQ ID NO: 10047435 - DNA, 22 bp, Homo sapiens
gaggtggccaagcgaggaaggg

SEQ ID NO: 10047436 - DNA, 22 bp, Homo sapiens
gaggtggcctcaagcagtcttc

SEQ ID NO: 10047437 - DNA, 22 bp, Homo sapiens
gaggtggcactgtgaggagcac

SEQ ID NO: 10047438 - DNA, 22 bp, Homo sapiens
gagttcagtgtttctagtagtg

SEQ ID NO: 10047439 - DNA, 22 bp, Homo sapiens
gagttcagtagttatagtctag

SEQ ID NO: 10047440 - DNA, 22 bp, Homo sapiens
atgtttaaagggttgagaaata

SEQ ID NO: 10047441 - DNA, 22 bp, Homo sapiens
gaggagaagggcacggagaaaa

SEQ ID NO: 10047442 - DNA, 22 bp, Homo sapiens
gaggagaagctattggaaggac

SEQ ID NO: 10047443 - DNA, 22 bp, Homo sapiens
gaggagaagctaagaaacacag

SEQ ID NO: 10047444 - DNA, 22 bp, Homo sapiens
gaggagaaatttggggacctga

SEQ ID NO: 10047445 - DNA, 21 bp, Homo sapiens
atggtggcacaaatttgatct

SEQ ID NO: 10047446 - DNA, 22 bp, Homo sapiens
gaggcagcatctatggtgggaa

SEQ ID NO: 10047447 - DNA, 22 bp, Homo sapiens
gaggcagcctcagtggacctcg

SEQ ID NO: 10047448 - DNA, 22 bp, Homo sapiens
gaggcagcctcagtggacctcg

SEQ ID NO: 10047449 - DNA, 22 bp, Homo sapiens
atggggagagaagggctgagct

SEQ ID NO: 10047450 - DNA, 22 bp, Homo sapiens
atggggagagcctctgtcccca

SEQ ID NO: 10047451 - DNA, 22 bp, Homo sapiens
atggggagagaagggctgagct

SEQ ID NO: 10047452 - DNA, 22 bp, Homo sapiens
atggggagagcctctgtcccca

SEQ ID NO: 10047453 - DNA, 22 bp, Homo sapiens
atggggagctcaccacctgttt

SEQ ID NO: 10047454 - DNA, 22 bp, Homo sapiens
gagatggggaataggagcaagc

SEQ ID NO: 10047455 - DNA, 22 bp, Homo sapiens
atggcttggcaccatctccttg

SEQ ID NO: 10047456 - DNA, 21 bp, Homo sapiens
atggagggaccagggaagcag

SEQ ID NO: 10047457 - DNA, 22 bp, Homo sapiens
atggagggtgtcagagagcgaa

SEQ ID NO: 10047458 - DNA, 22 bp, Homo sapiens
gagagtcactgtctgcatttcc

SEQ ID NO: 10047459 - DNA, 22 bp, Homo sapiens
gagatgggcgagaaggtggact

SEQ ID NO: 10047460 - DNA, 22 bp, Homo sapiens
gagagagctctgtgcctgggat

SEQ ID NO: 10047461 - DNA, 22 bp, Homo sapiens
gagagagctctgtgcctgggat

SEQ ID NO: 10047462 - DNA, 22 bp, Homo sapiens
gagagagaaggcctgtgggtgt

SEQ ID NO: 10047463 - DNA, 22 bp, Homo sapiens
gagagagagctaatattaagct

SEQ ID NO: 10047464 - DNA, 22 bp, Homo sapiens
gagagagaggtgctgccaggca

SEQ ID NO: 10047465 - DNA, 22 bp, Homo sapiens
gacataaagttcttgcttgaat

SEQ ID NO: 10047466 - DNA, 22 bp, Homo sapiens
gacataaatgaagtttgactat

SEQ ID NO: 10047467 - DNA, 22 bp, Homo sapiens
gaccaaggccaggccagggcgt

SEQ ID NO: 10047468 - DNA, 22 bp, Homo sapiens
gacacaaagtttgtcagaaatt

SEQ ID NO: 10047469 - DNA, 21 bp, Homo sapiens
gacacaaagggtagtaatggt

SEQ ID NO: 10047470 - DNA, 21 bp, Homo sapiens
gacacaaagggtagtaatggt

SEQ ID NO: 10047471 - DNA, 22 bp, Homo sapiens
gacaatttctcaatatagaaac

SEQ ID NO: 10047472 - DNA, 22 bp, Homo sapiens
gacgagagactccatccaccac

SEQ ID NO: 10047473 - DNA, 22 bp, Homo sapiens
gaccttgtgatctgcccacctt

SEQ ID NO: 10047474 - DNA, 22 bp, Homo sapiens
gaccttgtgatccagccacctt

SEQ ID NO: 10047475 - DNA, 22 bp, Homo sapiens
atgcacacgtaccctacaaggc

SEQ ID NO: 10047476 - DNA, 22 bp, Homo sapiens
atgcacagctgaacactctaaa

SEQ ID NO: 10047477 - DNA, 22 bp, Homo sapiens
gaacaatacaggctttattcct

SEQ ID NO: 10047478 - DNA, 22 bp, Homo sapiens
gaacaaacacatcccagcagtg

SEQ ID NO: 10047479 - DNA, 22 bp, Homo sapiens
gaacaaacacatcccagcagtg

SEQ ID NO: 10047480 - DNA, 22 bp, Homo sapiens
gaagtctggctgacgagagtta

SEQ ID NO: 10047481 - DNA, 22 bp, Homo sapiens
gaataattgtgatgcttgaagt

SEQ ID NO: 10047482 - DNA, 22 bp, Homo sapiens
gaatacaaacttaaggctttac

SEQ ID NO: 10047483 - DNA, 22 bp, Homo sapiens
gaataattttgatcagaaggga

SEQ ID NO: 10047484 - DNA, 22 bp, Homo sapiens
gaatcaaatcaagttcttttga

SEQ ID NO: 10047485 - DNA, 22 bp, Homo sapiens
gaatcacactcgtaagtgagtt

SEQ ID NO: 10047486 - DNA, 22 bp, Homo sapiens
gacaatgcagaagtacttgttc

SEQ ID NO: 10047487 - DNA, 21 bp, Homo sapiens
gacaatgcagtcttttttgga

SEQ ID NO: 10047488 - DNA, 22 bp, Homo sapiens
gaatcagataataagcaagcat

SEQ ID NO: 10047489 - DNA, 22 bp, Homo sapiens
cttctttaccaagagatagagt

SEQ ID NO: 10047490 - DNA, 22 bp, Homo sapiens
cttctttaccaagagatagagt

SEQ ID NO: 10047491 - DNA, 22 bp, Homo sapiens
cttctttaatgtatacaaaaga

SEQ ID NO: 10047492 - DNA, 22 bp, Homo sapiens
atgaaacagagtacttaatata

SEQ ID NO: 10047493 - DNA, 22 bp, Homo sapiens
atgaaacagtgaattagtcaag

SEQ ID NO: 10047494 - DNA, 22 bp, Homo sapiens
atgaaacagtgtgtatagcaaa

SEQ ID NO: 10047495 - DNA, 22 bp, Homo sapiens
atgaacagtatgcaacatgatt

SEQ ID NO: 10047496 - DNA, 22 bp, Homo sapiens
atgaagaaactgttctgggtgg

SEQ ID NO: 10047497 - DNA, 22 bp, Homo sapiens
ctttctcttgagcaagagctgt

SEQ ID NO: 10047498 - DNA, 22 bp, Homo sapiens
atgacataagtgaaaaacatca

SEQ ID NO: 10047499 - DNA, 22 bp, Homo sapiens
gaaaatgttagcttcatagtca

SEQ ID NO: 10047500 - DNA, 22 bp, Homo sapiens
atgatgaaattttctatcatgt

SEQ ID NO: 10047501 - DNA, 18 bp, Homo sapiens
atgatcttagcaaatatt

SEQ ID NO: 10047502 - DNA, 21 bp, Homo sapiens
gaaatactgccttaggagctg

SEQ ID NO: 10047503 - DNA, 19 bp, Homo sapiens
gaaagtcatagagcttgtc

SEQ ID NO: 10047504 - DNA, 22 bp, Homo sapiens
cactgcacttcagcctgggtga

SEQ ID NO: 10047505 - DNA, 22 bp, Homo sapiens
agcatttatttcttagaaattg

SEQ ID NO: 10047506 - DNA, 22 bp, Homo sapiens
agccaaagatcagtgtgcaagt

SEQ ID NO: 10047507 - DNA, 22 bp, Homo sapiens
agccaaagtccaaatgcagtgt

SEQ ID NO: 10047508 - DNA, 22 bp, Homo sapiens
cagaaactagatttagacacaa

SEQ ID NO: 10047509 - DNA, 22 bp, Homo sapiens
cacgttaacagctaacagatga

SEQ ID NO: 10047510 - DNA, 22 bp, Homo sapiens
cactaaaactacattggaaaca

SEQ ID NO: 10047511 - DNA, 22 bp, Homo sapiens
cacgggtggaatcagggactcc

SEQ ID NO: 10047512 - DNA, 22 bp, Homo sapiens
cacattgtagagattagaaaga

SEQ ID NO: 10047513 - DNA, 22 bp, Homo sapiens
cactagaaaggtacagattatg

SEQ ID NO: 10047514 - DNA, 22 bp, Homo sapiens
agcaggctaatcttgctgaaca

SEQ ID NO: 10047515 - DNA, 19 bp, Homo sapiens
agcaggctaggctgcctct

SEQ ID NO: 10047516 - DNA, 22 bp, Homo sapiens
cacatgggcacagagaacttgg

SEQ ID NO: 10047517 - DNA, 22 bp, Homo sapiens
cacatgcttagatttcagtgga

SEQ ID NO: 10047518 - DNA, 22 bp, Homo sapiens
cacagaaaaaggcttgaaaatc

SEQ ID NO: 10047519 - DNA, 22 bp, Homo sapiens
caatttttgtacttatagtact

SEQ ID NO: 10047520 - DNA, 22 bp, Homo sapiens
caatttttaaactatgaagttg

SEQ ID NO: 10047521 - DNA, 22 bp, Homo sapiens
agcaggcaggcccagcggctgg

SEQ ID NO: 10047522 - DNA, 22 bp, Homo sapiens
cacagctgccatgcagtcagtg

SEQ ID NO: 10047523 - DNA, 22 bp, Homo sapiens
cacagaacaccaaagaaccttc

SEQ ID NO: 10047524 - DNA, 22 bp, Homo sapiens
caattattcagtgacttaagag

SEQ ID NO: 10047525 - DNA, 22 bp, Homo sapiens
caattacatttattgagcattc

SEQ ID NO: 10047526 - DNA, 21 bp, Homo sapiens
caattacagatggctcagggg

SEQ ID NO: 10047527 - DNA, 22 bp, Homo sapiens
caagtcattactgaaatgtcac

SEQ ID NO: 10047528 - DNA, 22 bp, Homo sapiens
agcagacaggctgccacagtgc

SEQ ID NO: 10047529 - DNA, 21 bp, Homo sapiens
agcagacacttgtgaccttcc

SEQ ID NO: 10047530 - DNA, 21 bp, Homo sapiens
agcagacagatgcacgcacac

SEQ ID NO: 10047531 - DNA, 22 bp, Homo sapiens
agcagaccaggagtgcacaggt

SEQ ID NO: 10047532 - DNA, 22 bp, Homo sapiens
agcagagaccatatagcccaga

SEQ ID NO: 10047533 - DNA, 22 bp, Homo sapiens
caaggaaacatgaaatgcattg

SEQ ID NO: 10047534 - DNA, 22 bp, Homo sapiens
agcaattttcccttagtctttg

SEQ ID NO: 10047535 - DNA, 22 bp, Homo sapiens
agcaatttctcgcaccagacgc

SEQ ID NO: 10047536 - DNA, 22 bp, Homo sapiens
agcaattattgtataagaacaa

SEQ ID NO: 10047537 - DNA, 22 bp, Homo sapiens
cagatcttgtactcattattga

SEQ ID NO: 10047538 - DNA, 22 bp, Homo sapiens
agcctgcttcctcagggaacaa

SEQ ID NO: 10047539 - DNA, 22 bp, Homo sapiens
cagatcctttatagcagtgtcc

SEQ ID NO: 10047540 - DNA, 23 bp, Homo sapiens
agcccttgataataaagcaccag

SEQ ID NO: 10047541 - DNA, 22 bp, Homo sapiens
agcccttgagtgtatctcaaat

SEQ ID NO: 10047542 - DNA, 18 bp, Homo sapiens
cagagtgggccaagagac

SEQ ID NO: 10047543 - DNA, 22 bp, Homo sapiens
agccagggatgcagcacagtga

SEQ ID NO: 10047544 - DNA, 22 bp, Homo sapiens
cagagcaggggtttcccaggtt

SEQ ID NO: 10047545 - DNA, 22 bp, Homo sapiens
agccagggctgcgagcagacag

SEQ ID NO: 10047546 - DNA, 22 bp, Homo sapiens
cagagccaggtctaggagtctc

SEQ ID NO: 10047547 - DNA, 22 bp, Homo sapiens
cagagcagtctggagatccagc

SEQ ID NO: 10047548 - DNA, 22 bp, Homo sapiens
cagagccagggctaggaactgg

SEQ ID NO: 10047549 - DNA, 22 bp, Homo sapiens
cagagcagtccttgtcaatcag

SEQ ID NO: 10047550 - DNA, 23 bp, Homo sapiens
cagagctggctcagagctgcctg

SEQ ID NO: 10047551 - DNA, 22 bp, Homo sapiens
cagagctgtcatttgccagtga

SEQ ID NO: 10047552 - DNA, 21 bp, Homo sapiens
cagagctgtccaaaccctgac

SEQ ID NO: 10047553 - DNA, 22 bp, Homo sapiens
cagagctgttgcggggcttggc

SEQ ID NO: 10047554 - DNA, 22 bp, Homo sapiens
cagagctgttactattcatgaa

SEQ ID NO: 10047555 - DNA, 20 bp, Homo sapiens
cagagctgttatggatgatg

SEQ ID NO: 10047556 - DNA, 22 bp, Homo sapiens
cagagctgtccaaaccctgaca

SEQ ID NO: 10047557 - DNA, 22 bp, Homo sapiens
cagagctgtgataaatagatat

SEQ ID NO: 10047558 - DNA, 22 bp, Homo sapiens
cagagctgttactattcatgaa

SEQ ID NO: 10047559 - DNA, 22 bp, Homo sapiens
cagctgagagtagaaatggagg

SEQ ID NO: 10047560 - DNA, 22 bp, Homo sapiens
cagcggaggacagatgggagct

SEQ ID NO: 10047561 - DNA, 22 bp, Homo sapiens
cagctgccatgacatgtcctgc

SEQ ID NO: 10047562 - DNA, 22 bp, Homo sapiens
agctgagctgcagatgactgta

SEQ ID NO: 10047563 - DNA, 22 bp, Homo sapiens
agctgagccagcagcaacagga

SEQ ID NO: 10047564 - DNA, 21 bp, Homo sapiens
agctgagcccagaagactggt

SEQ ID NO: 10047565 - DNA, 22 bp, Homo sapiens
cagctggacttttgatagaagt

SEQ ID NO: 10047566 - DNA, 19 bp, Homo sapiens
cagctggaatcatctgagg

SEQ ID NO: 10047567 - DNA, 22 bp, Homo sapiens
cagctggaggagcagcttccag

SEQ ID NO: 10047568 - DNA, 22 bp, Homo sapiens
agcgccactgcactccagcctg

SEQ ID NO: 10047569 - DNA, 22 bp, Homo sapiens
cagcccaggtctctcttccagt

SEQ ID NO: 10047570 - DNA, 22 bp, Homo sapiens
cagcccaaagccccaggctaga

SEQ ID NO: 10047571 - DNA, 22 bp, Homo sapiens
cagccatcccagcctgtggttc

SEQ ID NO: 10047572 - DNA, 22 bp, Homo sapiens
cagcccagagatgttatctagt

SEQ ID NO: 10047573 - DNA, 22 bp, Homo sapiens
cagcccagaactcacgtctcca

SEQ ID NO: 10047574 - DNA, 22 bp, Homo sapiens
atgccacttcattccagcctcg

SEQ ID NO: 10047575 - DNA, 22 bp, Homo sapiens
atgccaggaacaaacagtggtg

SEQ ID NO: 10047576 - DNA, 22 bp, Homo sapiens
agacataagtgctatgacattg

SEQ ID NO: 10047577 - DNA, 22 bp, Homo sapiens
atgccatctgaaatctgtcata

SEQ ID NO: 10047578 - DNA, 22 bp, Homo sapiens
agagaacagacagatgcaatga

SEQ ID NO: 10047579 - DNA, 22 bp, Homo sapiens
atgcttctggtataagaaaaat

SEQ ID NO: 10047580 - DNA, 22 bp, Homo sapiens
atgcttctgtgtatgtttcagg

SEQ ID NO: 10047581 - DNA, 22 bp, Homo sapiens
agagaaaagagttcaggctttg

SEQ ID NO: 10047582 - DNA, 22 bp, Homo sapiens
atgattctcattttataaactt

SEQ ID NO: 10047583 - DNA, 22 bp, Homo sapiens
atgattctcattttataaactt

SEQ ID NO: 10047584 - DNA, 22 bp, Homo sapiens
atgattctctgctactctaaat

SEQ ID NO: 10047585 - DNA, 22 bp, Homo sapiens
atgattctggcaaatttattat

SEQ ID NO: 10047586 - DNA, 22 bp, Homo sapiens
atcttacacgataactgttagt

SEQ ID NO: 10047587 - DNA, 22 bp, Homo sapiens
atctgtttaattcattttcaca

SEQ ID NO: 10047588 - DNA, 17 bp, Homo sapiens
agagagaaaagggccat

SEQ ID NO: 10047589 - DNA, 21 bp, Homo sapiens
agagactgtcactgcagtacc

SEQ ID NO: 10047590 - DNA, 22 bp, Homo sapiens
agagacttaaaactgttttcac

SEQ ID NO: 10047591 - DNA, 22 bp, Homo sapiens
agagactttgtctattttgttc

SEQ ID NO: 10047592 - DNA, 22 bp, Homo sapiens
agagactggagatgggcagtgt

SEQ ID NO: 10047593 - DNA, 22 bp, Homo sapiens
agagactgtaatgagaggtaca

SEQ ID NO: 10047594 - DNA, 22 bp, Homo sapiens
atgtataatgctaattagctag

SEQ ID NO: 10047595 - DNA, 22 bp, Homo sapiens
agagaacagcctcctagagaaa

SEQ ID NO: 10047596 - DNA, 22 bp, Homo sapiens
atggacaatgtgaaactacaag

SEQ ID NO: 10047597 - DNA, 22 bp, Homo sapiens
agagctctggcctattggggcc

SEQ ID NO: 10047598 - DNA, 22 bp, Homo sapiens
attaaatactgcaggctaagca

SEQ ID NO: 10047599 - DNA, 22 bp, Homo sapiens
atgttcatccatgtcgtagcag

SEQ ID NO: 10047600 - DNA, 22 bp, Homo sapiens
atgttcatttgacaagtagtga

SEQ ID NO: 10047601 - DNA, 22 bp, Homo sapiens
atgttcattagtcaacatttct

SEQ ID NO: 10047602 - DNA, 22 bp, Homo sapiens
atgttctacagatggaaagggg

SEQ ID NO: 10047603 - DNA, 22 bp, Homo sapiens
atgttctacagatggaaagggg

SEQ ID NO: 10047604 - DNA, 22 bp, Homo sapiens
agagccagcaagtgaatagtga

SEQ ID NO: 10047605 - DNA, 22 bp, Homo sapiens
agagccagcatttgacactggc

SEQ ID NO: 10047606 - DNA, 22 bp, Homo sapiens
agagccagcatttgggccctgc

SEQ ID NO: 10047607 - DNA, 22 bp, Homo sapiens
agagccaggaagtggcgtgggg

SEQ ID NO: 10047608 - DNA, 22 bp, Homo sapiens
agagccaggactgtgtctcact

SEQ ID NO: 10047609 - DNA, 22 bp, Homo sapiens
agagccaggatctgttttgggg

SEQ ID NO: 10047610 - DNA, 22 bp, Homo sapiens
agagatggtagaacagtcataa

SEQ ID NO: 10047611 - DNA, 22 bp, Homo sapiens
atgtgcataaacatattgttgg

SEQ ID NO: 10047612 - DNA, 22 bp, Homo sapiens
attatttgagttcctctctacc

SEQ ID NO: 10047613 - DNA, 22 bp, Homo sapiens
agaggccggccgagcccatggg

SEQ ID NO: 10047614 - DNA, 22 bp, Homo sapiens
agaggccggccgagcccatggg

SEQ ID NO: 10047615 - DNA, 22 bp, Homo sapiens
agagctgtttgtctagagagtg

SEQ ID NO: 10047616 - DNA, 22 bp, Homo sapiens
attctaaagcttgtggagctta

SEQ ID NO: 10047617 - DNA, 22 bp, Homo sapiens
attctaaatgtaatttagaatt

SEQ ID NO: 10047618 - DNA, 22 bp, Homo sapiens
attctaaatcagagagctctgt

SEQ ID NO: 10047619 - DNA, 22 bp, Homo sapiens
attctaaagcttgtggagctta

SEQ ID NO: 10047620 - DNA, 22 bp, Homo sapiens
attctaagtgcttgtggtggtt

SEQ ID NO: 10047621 - DNA, 22 bp, Homo sapiens
attgaaaataaggccagaaaca

SEQ ID NO: 10047622 - DNA, 22 bp, Homo sapiens
attgaaaaattcacaattctgg

SEQ ID NO: 10047623 - DNA, 22 bp, Homo sapiens
agatacaagttaagagaaagga

SEQ ID NO: 10047624 - DNA, 22 bp, Homo sapiens
attgtatttgtacaagacatgt

SEQ ID NO: 10047625 - DNA, 22 bp, Homo sapiens
attgtattagcacaatacaatt

SEQ ID NO: 10047626 - DNA, 22 bp, Homo sapiens
attgtattataattaggccaaa

SEQ ID NO: 10047627 - DNA, 22 bp, Homo sapiens
attgtattcagttacaggtctt

SEQ ID NO: 10047628 - DNA, 22 bp, Homo sapiens
attgtattataattaggccaaa

SEQ ID NO: 10047629 - DNA, 22 bp, Homo sapiens
attgtatttaggagaaaagggt

SEQ ID NO: 10047630 - DNA, 22 bp, Homo sapiens
caaagtgctgggattacaggtg

SEQ ID NO: 10047631 - DNA, 22 bp, Homo sapiens
caaagtgctgggattacaggct

SEQ ID NO: 10047632 - DNA, 22 bp, Homo sapiens
attttttcccagttagccagga

SEQ ID NO: 10047633 - DNA, 22 bp, Homo sapiens
attttttctgtaaactggcctt

SEQ ID NO: 10047634 - DNA, 22 bp, Homo sapiens
attttttcagattgagtgttaa

SEQ ID NO: 10047635 - DNA, 22 bp, Homo sapiens
attttttcagattgagtgttaa

SEQ ID NO: 10047636 - DNA, 23 bp, Homo sapiens
atttacagctgtgtgagcaagtt

SEQ ID NO: 10047637 - DNA, 21 bp, Homo sapiens
agatgaggatactgaggccta

SEQ ID NO: 10047638 - DNA, 22 bp, Homo sapiens
agattggatcaagcagcagttg

SEQ ID NO: 10047639 - DNA, 22 bp, Homo sapiens
atacttaactgtggagtcattg

SEQ ID NO: 10047640 - DNA, 22 bp, Homo sapiens
atagaagcaagaacagaatgga

SEQ ID NO: 10047641 - DNA, 23 bp, Homo sapiens
atagaagattattgcaacagtcc

SEQ ID NO: 10047642 - DNA, 22 bp, Homo sapiens
atagaacaaggtagacagcttt

SEQ ID NO: 10047643 - DNA, 20 bp, Homo sapiens
ataggaaagggaggggcttt

SEQ ID NO: 10047644 - DNA, 22 bp, Homo sapiens
atagctttttgtcatagagtct

SEQ ID NO: 10047645 - DNA, 22 bp, Homo sapiens
agaaaacttgtcacagctctca

SEQ ID NO: 10047646 - DNA, 22 bp, Homo sapiens
agaaaacttgctcgagcctgtt

SEQ ID NO: 10047647 - DNA, 22 bp, Homo sapiens
agttcaggcataaggcatgaac

SEQ ID NO: 10047648 - DNA, 23 bp, Homo sapiens
agttcactgaggttgaccactgg

SEQ ID NO: 10047649 - DNA, 22 bp, Homo sapiens
agttcactgcttaagcctttga

SEQ ID NO: 10047650 - DNA, 22 bp, Homo sapiens
agttcacagaatggccagaact

SEQ ID NO: 10047651 - DNA, 22 bp, Homo sapiens
agttgcagacgcagagatgttg

SEQ ID NO: 10047652 - DNA, 22 bp, Homo sapiens
ataaattctctgatgtatagta

SEQ ID NO: 10047653 - DNA, 22 bp, Homo sapiens
ataacagacttagagttacaag

SEQ ID NO: 10047654 - DNA, 22 bp, Homo sapiens
ataacagagagctactgaactg

SEQ ID NO: 10047655 - DNA, 22 bp, Homo sapiens
ataacagaataagtcattaccg

SEQ ID NO: 10047656 - DNA, 22 bp, Homo sapiens
ataacactaaatgtatgtaaca

SEQ ID NO: 10047657 - DNA, 22 bp, Homo sapiens
ataacagaataagtcattaccg

SEQ ID NO: 10047658 - DNA, 22 bp, Homo sapiens
ataaattttcttgctgtactta

SEQ ID NO: 10047659 - DNA, 22 bp, Homo sapiens
ataacaatagtggtagtgctgg

SEQ ID NO: 10047660 - DNA, 22 bp, Homo sapiens
ataaatttataattgtttcctg

SEQ ID NO: 10047661 - DNA, 22 bp, Homo sapiens
atacaatgaagtatagatgaaa

SEQ ID NO: 10047662 - DNA, 22 bp, Homo sapiens
atacaatgagtgagtgaatggg

SEQ ID NO: 10047663 - DNA, 22 bp, Homo sapiens
atacaatgataatagtacttta

SEQ ID NO: 10047664 - DNA, 22 bp, Homo sapiens
atacactaatcatgtgctcagt

SEQ ID NO: 10047665 - DNA, 19 bp, Homo sapiens
atacacgtgtatacataca

SEQ ID NO: 10047666 - DNA, 22 bp, Homo sapiens
atacacagccattatgaattag

SEQ ID NO: 10047667 - DNA, 22 bp, Homo sapiens
atacacagcgatgagaggaggc

SEQ ID NO: 10047668 - DNA, 22 bp, Homo sapiens
atacacagctacattgaacaat

SEQ ID NO: 10047669 - DNA, 22 bp, Homo sapiens
atacaagttgtgataatgtaaa

SEQ ID NO: 10047670 - DNA, 22 bp, Homo sapiens
agaaagaacgcacttgtgctgc

SEQ ID NO: 10047671 - DNA, 17 bp, Homo sapiens
agaaactgaggctcagt

SEQ ID NO: 10047672 - DNA, 22 bp, Homo sapiens
agaaatcacttagaggaagtga

SEQ ID NO: 10047673 - DNA, 22 bp, Homo sapiens
agaaatcacaggaggcagaagg

SEQ ID NO: 10047674 - DNA, 22 bp, Homo sapiens
atcaagagttatatttcatagt

SEQ ID NO: 10047675 - DNA, 22 bp, Homo sapiens
atcaagagaaggggaagatgaa

SEQ ID NO: 10047676 - DNA, 22 bp, Homo sapiens
agaagctgcgtttatttaaatc

SEQ ID NO: 10047677 - DNA, 22 bp, Homo sapiens
agaagctgcctacatgaccagc

SEQ ID NO: 10047678 - DNA, 22 bp, Homo sapiens
agaagctgacagatgcagcagg

SEQ ID NO: 10047679 - DNA, 22 bp, Homo sapiens
agaagctgacagatgcagcagg

SEQ ID NO: 10047680 - DNA, 22 bp, Homo sapiens
agaaattaggaaagtaacactt

SEQ ID NO: 10047681 - DNA, 19 bp, Homo sapiens
agaagcaccagtcattcct

SEQ ID NO: 10047682 - DNA, 22 bp, Homo sapiens
agaaatgtaattgcaactgtct

SEQ ID NO: 10047683 - DNA, 22 bp, Homo sapiens
agaaatgtatagtgaatttttc

SEQ ID NO: 10047684 - DNA, 22 bp, Homo sapiens
agaaatgttacagttgttattt

SEQ ID NO: 10047685 - DNA, 22 bp, Homo sapiens
agaaatgtccagggctaggatc

SEQ ID NO: 10047686 - DNA, 22 bp, Homo sapiens
aggtggggaaaccagcgatccc

SEQ ID NO: 10047687 - DNA, 22 bp, Homo sapiens
aggtgcttggctcgtgcacaca

SEQ ID NO: 10047688 - DNA, 22 bp, Homo sapiens
actcagaggcagctgctcaccc

SEQ ID NO: 10047689 - DNA, 22 bp, Homo sapiens
agtccttcaagaaatctggaaa

SEQ ID NO: 10047690 - DNA, 22 bp, Homo sapiens
agtccttcccatctgacaccct

SEQ ID NO: 10047691 - DNA, 22 bp, Homo sapiens
agtccttccggcagatttcact

SEQ ID NO: 10047692 - DNA, 22 bp, Homo sapiens
agtccttcacgtcctgcttatt

SEQ ID NO: 10047693 - DNA, 22 bp, Homo sapiens
agtcctgtctctcccagggcca

SEQ ID NO: 10047694 - DNA, 22 bp, Homo sapiens
actggtaacaatggaagcttct

SEQ ID NO: 10047695 - DNA, 22 bp, Homo sapiens
actggttgaagaaaagctagta

SEQ ID NO: 10047696 - DNA, 22 bp, Homo sapiens
agttacagtgttctattactct

SEQ ID NO: 10047697 - DNA, 20 bp, Homo sapiens
agtgtctggtgcagggcctc

SEQ ID NO: 10047698 - DNA, 22 bp, Homo sapiens
agtgtctgaaccaccggggcat

SEQ ID NO: 10047699 - DNA, 22 bp, Homo sapiens
agtggggccggtgaggccgagg

SEQ ID NO: 10047700 - DNA, 22 bp, Homo sapiens
agtggggcggacaggaccagga

SEQ ID NO: 10047701 - DNA, 22 bp, Homo sapiens
agtggggcggacaggaccagga

SEQ ID NO: 10047702 - DNA, 22 bp, Homo sapiens
agtgtgtaagggatcaaagagt

SEQ ID NO: 10047703 - DNA, 22 bp, Homo sapiens
agtgtgtacataattgtacgcc

SEQ ID NO: 10047704 - DNA, 17 bp, Homo sapiens
agtgtgtgaaatggtgg

SEQ ID NO: 10047705 - DNA, 22 bp, Homo sapiens
agtgagcatcttcaggagccaa

SEQ ID NO: 10047706 - DNA, 17 bp, Homo sapiens
agtgagaatgtcatgta

SEQ ID NO: 10047707 - DNA, 18 bp, Homo sapiens
agtccttcttggttttac

SEQ ID NO: 10047708 - DNA, 22 bp, Homo sapiens
agtccttccggcagatttcact

SEQ ID NO: 10047709 - DNA, 22 bp, Homo sapiens
agtccttcttttagttgcttgg

SEQ ID NO: 10047710 - DNA, 22 bp, Homo sapiens
agtgctgaagactggctaggga

SEQ ID NO: 10047711 - DNA, 22 bp, Homo sapiens
agtgctttccctgaaaccttcc

SEQ ID NO: 10047712 - DNA, 22 bp, Homo sapiens
agtgctttcagtgtgctctttt

SEQ ID NO: 10047713 - DNA, 22 bp, Homo sapiens
agtgcttctggtgggcgtgagg

SEQ ID NO: 10047714 - DNA, 22 bp, Homo sapiens
agtgcttcttaaacctttctac

SEQ ID NO: 10047715 - DNA, 22 bp, Homo sapiens
agtggcagacagagacagtacc

SEQ ID NO: 10047716 - DNA, 22 bp, Homo sapiens
agtggcagagaccccagccagc

SEQ ID NO: 10047717 - DNA, 22 bp, Homo sapiens
agtgctttgaacgaaaggctga

SEQ ID NO: 10047718 - DNA, 22 bp, Homo sapiens
agtggggccgcggtcctgccct

SEQ ID NO: 10047719 - DNA, 22 bp, Homo sapiens
acatctgtttgagaaaaagaag

SEQ ID NO: 10047720 - DNA, 22 bp, Homo sapiens
aggcagaagccagccagggtcc

SEQ ID NO: 10047721 - DNA, 22 bp, Homo sapiens
aggcacagcacacctggccccc

SEQ ID NO: 10047722 - DNA, 22 bp, Homo sapiens
aggcactttttgcattttagaa

SEQ ID NO: 10047723 - DNA, 22 bp, Homo sapiens
acagtgcttctgatatgatgcc

SEQ ID NO: 10047724 - DNA, 19 bp, Homo sapiens
acagtgcttctgagtgagg

SEQ ID NO: 10047725 - DNA, 22 bp, Homo sapiens
aggactgttttttcttctaggg

SEQ ID NO: 10047726 - DNA, 22 bp, Homo sapiens
acagcagttaacgatcagactc

SEQ ID NO: 10047727 - DNA, 22 bp, Homo sapiens
acagccagaggagccaggctgg

SEQ ID NO: 10047728 - DNA, 22 bp, Homo sapiens
acagccactcaaagggccgaag

SEQ ID NO: 10047729 - DNA, 22 bp, Homo sapiens
acagcattgctccatctcaaga

SEQ ID NO: 10047730 - DNA, 22 bp, Homo sapiens
acaggactctctgaaaatgtac

SEQ ID NO: 10047731 - DNA, 22 bp, Homo sapiens
acaggactagatgataaaatgt

SEQ ID NO: 10047732 - DNA, 22 bp, Homo sapiens
acaggactgtgatccagtaacc

SEQ ID NO: 10047733 - DNA, 22 bp, Homo sapiens
acaggacagggaattcgaaatt

SEQ ID NO: 10047734 - DNA, 22 bp, Homo sapiens
acaggcacaactgagtagactc

SEQ ID NO: 10047735 - DNA, 18 bp, Homo sapiens
aggaaagaaaggcaggtg

SEQ ID NO: 10047736 - DNA, 22 bp, Homo sapiens
acaggatgataaaggatggcca

SEQ ID NO: 10047737 - DNA, 22 bp, Homo sapiens
acaggatggagataatagaaaa

SEQ ID NO: 10047738 - DNA, 22 bp, Homo sapiens
aggactggcagtgtgaggggtc

SEQ ID NO: 10047739 - DNA, 22 bp, Homo sapiens
aggacaggtgtagtgggctctg

SEQ ID NO: 10047740 - DNA, 22 bp, Homo sapiens
agggaggatctgctccttgtct

SEQ ID NO: 10047741 - DNA, 22 bp, Homo sapiens
agggaggagtcctcaaagtcat

SEQ ID NO: 10047742 - DNA, 22 bp, Homo sapiens
accagagcccatctgctcctag

SEQ ID NO: 10047743 - DNA, 20 bp, Homo sapiens
accagagactggggacaagt

SEQ ID NO: 10047744 - DNA, 20 bp, Homo sapiens
accagagacctgaatcagtt

SEQ ID NO: 10047745 - DNA, 22 bp, Homo sapiens
accagagaatttagccaagaaa

SEQ ID NO: 10047746 - DNA, 22 bp, Homo sapiens
accagagaaaacacagcaggct

SEQ ID NO: 10047747 - DNA, 22 bp, Homo sapiens
accagagagagacagggttgtg

SEQ ID NO: 10047748 - DNA, 22 bp, Homo sapiens
accagagagcctaggctgggca

SEQ ID NO: 10047749 - DNA, 22 bp, Homo sapiens
accagagatgtctaataggggc

SEQ ID NO: 10047750 - DNA, 22 bp, Homo sapiens
accagagaggctgcagtgtgtg

SEQ ID NO: 10047751 - DNA, 20 bp, Homo sapiens
accagagatagcaatagtgc

SEQ ID NO: 10047752 - DNA, 20 bp, Homo sapiens
agggaggtgctgggcctgag

SEQ ID NO: 10047753 - DNA, 22 bp, Homo sapiens
agggcactggcttgcaaactca

SEQ ID NO: 10047754 - DNA, 22 bp, Homo sapiens
agggccagcactcctggcagga

SEQ ID NO: 10047755 - DNA, 22 bp, Homo sapiens
aggggagccgaggggcatctgt

SEQ ID NO: 10047756 - DNA, 22 bp, Homo sapiens
aggggagcaaggccgtggtgta

SEQ ID NO: 10047757 - DNA, 22 bp, Homo sapiens
aggggagcaaggccgtggtgta

SEQ ID NO: 10047758 - DNA, 22 bp, Homo sapiens
aggggagcaaggccgtggtgta

SEQ ID NO: 10047759 - DNA, 22 bp, Homo sapiens
aggggagcttgcctggtcaccc

SEQ ID NO: 10047760 - DNA, 22 bp, Homo sapiens
aggggagcttgaggcatggcct

SEQ ID NO: 10047761 - DNA, 22 bp, Homo sapiens
aggggagctaacaccagagccc

SEQ ID NO: 10047762 - DNA, 22 bp, Homo sapiens
aggggagccgaggggcatctgt

SEQ ID NO: 10047763 - DNA, 21 bp, Homo sapiens
aggggcccttgccaggacgcc

SEQ ID NO: 10047764 - DNA, 22 bp, Homo sapiens
aggggtggagagtgttgccagt

SEQ ID NO: 10047765 - DNA, 23 bp, Homo sapiens
aggggtggtcagtacccgcagtg

SEQ ID NO: 10047766 - DNA, 22 bp, Homo sapiens
acatggcgggagtttcagatac

SEQ ID NO: 10047767 - DNA, 22 bp, Homo sapiens
acatgtaagactagcttaaagt

SEQ ID NO: 10047768 - DNA, 22 bp, Homo sapiens
acatgtattgacattatattct

SEQ ID NO: 10047769 - DNA, 20 bp, Homo sapiens
acatgtacagacaggtttct

SEQ ID NO: 10047770 - DNA, 22 bp, Homo sapiens
acattaaatttcatagtgatta

SEQ ID NO: 10047771 - DNA, 22 bp, Homo sapiens
aggctccagtctcctctggcag

SEQ ID NO: 10047772 - DNA, 22 bp, Homo sapiens
aggctccagtctcctctggcag

SEQ ID NO: 10047773 - DNA, 22 bp, Homo sapiens
acattaaaaaatgttgcatgaa

SEQ ID NO: 10047774 - DNA, 22 bp, Homo sapiens
aggctctggagtgtggtgctgg

SEQ ID NO: 10047775 - DNA, 22 bp, Homo sapiens
aggctctggacagtgaggagtt

SEQ ID NO: 10047776 - DNA, 18 bp, Homo sapiens
acatttctccttctgacc

SEQ ID NO: 10047777 - DNA, 23 bp, Homo sapiens
aggctggcttcaggagcctctcc

SEQ ID NO: 10047778 - DNA, 22 bp, Homo sapiens
aggctgtgagaagtccttcagt

SEQ ID NO: 10047779 - DNA, 22 bp, Homo sapiens
aggctgtgagttttgtctcaga

SEQ ID NO: 10047780 - DNA, 22 bp, Homo sapiens
acacataagcctaatcatctcc

SEQ ID NO: 10047781 - DNA, 23 bp, Homo sapiens
acagaaagttctgctggacagag

SEQ ID NO: 10047782 - DNA, 22 bp, Homo sapiens
acacttgccatgctgcacactg

SEQ ID NO: 10047783 - DNA, 22 bp, Homo sapiens
acactgtaaacatctcaagcac

SEQ ID NO: 10047784 - DNA, 22 bp, Homo sapiens
acagacctctagattacatttg

SEQ ID NO: 10047785 - DNA, 22 bp, Homo sapiens
acagaccagctttcattccctt

SEQ ID NO: 10047786 - DNA, 22 bp, Homo sapiens
acagagcaacttgagtatcctc

SEQ ID NO: 10047787 - DNA, 23 bp, Homo sapiens
acagacaacactgatgagagaaa

SEQ ID NO: 10047788 - DNA, 22 bp, Homo sapiens
acagccaggagccatgggcagg

SEQ ID NO: 10047789 - DNA, 23 bp, Homo sapiens
acagccaggatgggagcagaagc

SEQ ID NO: 10047790 - DNA, 22 bp, Homo sapiens
acagccaggcccagcacgcagg

SEQ ID NO: 10047791 - DNA, 22 bp, Homo sapiens
acagccaggacttggccctctt

SEQ ID NO: 10047792 - DNA, 22 bp, Homo sapiens
acagccagatctgagagatctt

SEQ ID NO: 10047793 - DNA, 23 bp, Homo sapiens
aagccccaaggaacttcctggga

SEQ ID NO: 10047794 - DNA, 22 bp, Homo sapiens
aagcccagctgaaagcattttt

SEQ ID NO: 10047795 - DNA, 22 bp, Homo sapiens
aagcccataaaaagaggtccct

SEQ ID NO: 10047796 - DNA, 22 bp, Homo sapiens
acacagcaaggtctgactttgg

SEQ ID NO: 10047797 - DNA, 22 bp, Homo sapiens
aagagtttccagttgtggctca

SEQ ID NO: 10047798 - DNA, 22 bp, Homo sapiens
aagataatattcattaactaga

SEQ ID NO: 10047799 - DNA, 22 bp, Homo sapiens
aagataatgtgtctgtctttgc

SEQ ID NO: 10047800 - DNA, 17 bp, Homo sapiens
acacagacaggcagaca

SEQ ID NO: 10047801 - DNA, 17 bp, Homo sapiens
acacagagattaacaca

SEQ ID NO: 10047802 - DNA, 20 bp, Homo sapiens
acacagactcagcttggatg

SEQ ID NO: 10047803 - DNA, 22 bp, Homo sapiens
acacagaagctttttctattcc

SEQ ID NO: 10047804 - DNA, 22 bp, Homo sapiens
acacagagcaaatcatgacaga

SEQ ID NO: 10047805 - DNA, 22 bp, Homo sapiens
acacagagccaaaccatatcac

SEQ ID NO: 10047806 - DNA, 22 bp, Homo sapiens
acacagagccagggaatacagt

SEQ ID NO: 10047807 - DNA, 22 bp, Homo sapiens
acacagcaacttgcagtatgga

SEQ ID NO: 10047808 - DNA, 22 bp, Homo sapiens
acacagcaacttgcagtatgga

SEQ ID NO: 10047809 - DNA, 22 bp, Homo sapiens
acacagagctggaactgcttca

SEQ ID NO: 10047810 - DNA, 22 bp, Homo sapiens
acacagagctggaactgcttca

SEQ ID NO: 10047811 - DNA, 22 bp, Homo sapiens
acacagagcttctcaactggga

SEQ ID NO: 10047812 - DNA, 22 bp, Homo sapiens
acaaggctgttggtcacaaacc

SEQ ID NO: 10047813 - DNA, 22 bp, Homo sapiens
acaacaaaatcactagtcttcc

SEQ ID NO: 10047814 - DNA, 21 bp, Homo sapiens
acaaattgtttatataggaag

SEQ ID NO: 10047815 - DNA, 22 bp, Homo sapiens
acaaattgttgcttcatgaatg

SEQ ID NO: 10047816 - DNA, 22 bp, Homo sapiens
acaacaaaatcactagtcttcc

SEQ ID NO: 10047817 - DNA, 22 bp, Homo sapiens
acaatatagtccatgagcatgc

SEQ ID NO: 10047818 - DNA, 22 bp, Homo sapiens
acaatatagtccatgagcatgc

SEQ ID NO: 10047819 - DNA, 22 bp, Homo sapiens
aagaactgagtacgttaataaa

SEQ ID NO: 10047820 - DNA, 22 bp, Homo sapiens
aagaacagattcagcctgaact

SEQ ID NO: 10047821 - DNA, 22 bp, Homo sapiens
aatgtacaataagacaaagagg

SEQ ID NO: 10047822 - DNA, 22 bp, Homo sapiens
aagaacattgatattgtctatg

SEQ ID NO: 10047823 - DNA, 22 bp, Homo sapiens
acaaaacagtgttcctgcccct

SEQ ID NO: 10047824 - DNA, 22 bp, Homo sapiens
acaaaacagtgttcctgcccct

SEQ ID NO: 10047825 - DNA, 22 bp, Homo sapiens
acaaaagcactgcagagtaagc

SEQ ID NO: 10047826 - DNA, 22 bp, Homo sapiens
acaaaagcttttggagggttgt

SEQ ID NO: 10047827 - DNA, 22 bp, Homo sapiens
acaaaagtgtaggaattcctta

SEQ ID NO: 10047828 - DNA, 22 bp, Homo sapiens
aagaatcatctgaactttgagg

SEQ ID NO: 10047829 - DNA, 22 bp, Homo sapiens
acaaatgaacctgaaatctcag

SEQ ID NO: 10047830 - DNA, 19 bp, Homo sapiens
acaaattgtcctcatcaag

SEQ ID NO: 10047831 - DNA, 22 bp, Homo sapiens
aagaatctgacataatttcctg

SEQ ID NO: 10047832 - DNA, 22 bp, Homo sapiens
aagaatctatggtacatccaag

SEQ ID NO: 10047833 - DNA, 22 bp, Homo sapiens
aatctcttgtatttcctttgac

SEQ ID NO: 10047834 - DNA, 22 bp, Homo sapiens
aatgcacatgccacatgtggta

SEQ ID NO: 10047835 - DNA, 22 bp, Homo sapiens
aatgcttatgggttccataata

SEQ ID NO: 10047836 - DNA, 22 bp, Homo sapiens
aatgcttaattcaatactgtgt

SEQ ID NO: 10047837 - DNA, 22 bp, Homo sapiens
aatgcttataacgttagaatgt

SEQ ID NO: 10047838 - DNA, 22 bp, Homo sapiens
aatgcttatacctaatgatctt

SEQ ID NO: 10047839 - DNA, 22 bp, Homo sapiens
aatgcttatacctaatgatctt

SEQ ID NO: 10047840 - DNA, 22 bp, Homo sapiens
aactttaaaaaatatgtctgtt

SEQ ID NO: 10047841 - DNA, 22 bp, Homo sapiens
aatatttatatttctcttccct

SEQ ID NO: 10047842 - DNA, 22 bp, Homo sapiens
aatctcaagctgtaaatacctc

SEQ ID NO: 10047843 - DNA, 22 bp, Homo sapiens
aatacataataagttttgtctg

SEQ ID NO: 10047844 - DNA, 22 bp, Homo sapiens
aagttacagttacagaatggag

SEQ ID NO: 10047845 - DNA, 22 bp, Homo sapiens
aatacagaggggtcacaattca

SEQ ID NO: 10047846 - DNA, 22 bp, Homo sapiens
aataatgtctgctattttaaaa

SEQ ID NO: 10047847 - DNA, 22 bp, Homo sapiens
aataatgtaggatgataaatga

SEQ ID NO: 10047848 - DNA, 22 bp, Homo sapiens
aataatatttgaagcttcaaag

SEQ ID NO: 10047849 - DNA, 22 bp, Homo sapiens
aataatcttgactactgaatca

SEQ ID NO: 10047850 - DNA, 22 bp, Homo sapiens
aataatctccctttttgtatgt

SEQ ID NO: 10047851 - DNA, 22 bp, Homo sapiens
aataatgagacagcttatttaa

SEQ ID NO: 10047852 - DNA, 22 bp, Homo sapiens
aataatgaacatttaaaacctg

SEQ ID NO: 10047853 - DNA, 22 bp, Homo sapiens
aataatgataatggttatagct

SEQ ID NO: 10047854 - DNA, 22 bp, Homo sapiens
aagtccaggtcctcattccatc

SEQ ID NO: 10047855 - DNA, 21 bp, Homo sapiens
aagtaatgtgtctcttctacc

SEQ ID NO: 10047856 - DNA, 22 bp, Homo sapiens
aagtaatggttaaataattcta

SEQ ID NO: 10047857 - DNA, 22 bp, Homo sapiens
aagtctgtttgagtgtcacact

SEQ ID NO: 10047858 - DNA, 22 bp, Homo sapiens
aagtctggaagtctcagttttc

SEQ ID NO: 10047859 - DNA, 21 bp, Homo sapiens
aagtgccacccacagatgcat

SEQ ID NO: 10047860 - DNA, 22 bp, Homo sapiens
aacagtgctgcattcattgagc

SEQ ID NO: 10047861 - DNA, 22 bp, Homo sapiens
aacagtgtgtacacatcatagg

SEQ ID NO: 10047862 - DNA, 22 bp, Homo sapiens
aaggcccttccaccagtcctcg

SEQ ID NO: 10047863 - DNA, 22 bp, Homo sapiens
aaggccctggccccagcttctt

SEQ ID NO: 10047864 - DNA, 22 bp, Homo sapiens
aaggagtctgggccattcagag

SEQ ID NO: 10047865 - DNA, 22 bp, Homo sapiens
aaggataaaaaccacttctaat

SEQ ID NO: 10047866 - DNA, 22 bp, Homo sapiens
aaggagtctgggccattcagag

SEQ ID NO: 10047867 - DNA, 22 bp, Homo sapiens
aaggagaagggtaatcaacaca

SEQ ID NO: 10047868 - DNA, 22 bp, Homo sapiens
aaatggcactttgacagcctgc

SEQ ID NO: 10047869 - DNA, 22 bp, Homo sapiens
aaatcaaaagacatgtgtttta

SEQ ID NO: 10047870 - DNA, 22 bp, Homo sapiens
aaatcagagtctgattttaagg

SEQ ID NO: 10047871 - DNA, 22 bp, Homo sapiens
aaatgaacagttgcattctctg

SEQ ID NO: 10047872 - DNA, 23 bp, Homo sapiens
aaatgacatatggtttctgaagg

SEQ ID NO: 10047873 - DNA, 22 bp, Homo sapiens
aaatcagaggcaacaactactt

SEQ ID NO: 10047874 - DNA, 22 bp, Homo sapiens
aaatcagacttgaattttcatc

SEQ ID NO: 10047875 - DNA, 22 bp, Homo sapiens
aaatgcaattcaggaagacaag

SEQ ID NO: 10047876 - DNA, 22 bp, Homo sapiens
aaatgcaattcaggaagacaag

SEQ ID NO: 10047877 - DNA, 22 bp, Homo sapiens
aaatgcacagaaaggatgtgga

SEQ ID NO: 10047878 - DNA, 22 bp, Homo sapiens
aaatgcttcacctcattaaact

SEQ ID NO: 10047879 - DNA, 22 bp, Homo sapiens
aaatgcttcacctcattaaact

SEQ ID NO: 10047880 - DNA, 22 bp, Homo sapiens
aaatgcttgcaacatcccaggt

SEQ ID NO: 10047881 - DNA, 22 bp, Homo sapiens
aaatgctttggtgctggtacag

SEQ ID NO: 10047882 - DNA, 21 bp, Homo sapiens
aaatgctttgtatatatctgt

SEQ ID NO: 10047883 - DNA, 22 bp, Homo sapiens
aaatgcttgtaaattttccatg

SEQ ID NO: 10047884 - DNA, 22 bp, Homo sapiens
aaatgcttgctcttgattattt

SEQ ID NO: 10047885 - DNA, 21 bp, Homo sapiens
aaatgctttgtatatatctgt

SEQ ID NO: 10047886 - DNA, 20 bp, Homo sapiens
aaatgcttttgacacatatt

SEQ ID NO: 10047887 - DNA, 22 bp, Homo sapiens
aaatgctgcagctagtgtgttt

SEQ ID NO: 10047888 - DNA, 22 bp, Homo sapiens
aaatgcttagaggtgttcaaat

SEQ ID NO: 10047889 - DNA, 22 bp, Homo sapiens
aaatgcttattagtgtcacaaa

SEQ ID NO: 10047890 - DNA, 22 bp, Homo sapiens
aaatgcttagaggtgttcaaat

SEQ ID NO: 10047891 - DNA, 22 bp, Homo sapiens
aaatgcttattagtgtcacaaa

SEQ ID NO: 10047892 - DNA, 22 bp, Homo sapiens
aaatgcttattagtgtcacaaa

SEQ ID NO: 10047893 - DNA, 22 bp, Homo sapiens
aagagagaactcccttcgccag

SEQ ID NO: 10047894 - DNA, 22 bp, Homo sapiens
aaatacatacactgtacgtggc

SEQ ID NO: 10047895 - DNA, 22 bp, Homo sapiens
aaatacataaaggttgtaccag

SEQ ID NO: 10047896 - DNA, 22 bp, Homo sapiens
aagagtttcttactggcatcta

SEQ ID NO: 10047897 - DNA, 22 bp, Homo sapiens
aaatatgactagaatgccaggt

SEQ ID NO: 10047898 - DNA, 22 bp, Homo sapiens
aagagtttttggagtgtgagtt

SEQ ID NO: 10047899 - DNA, 22 bp, Homo sapiens
aagagttttctctgatggcatt

SEQ ID NO: 10047900 - DNA, 22 bp, Homo sapiens
aagagtttgacctgtgccatcc

SEQ ID NO: 10047901 - DNA, 22 bp, Homo sapiens
aagagagacaataggtagcatt

SEQ ID NO: 10047902 - DNA, 22 bp, Homo sapiens
aacttgaaactgttccagaaaa

SEQ ID NO: 10047903 - DNA, 22 bp, Homo sapiens
aaagtccttgcagtttcctctt

SEQ ID NO: 10047904 - DNA, 20 bp, Homo sapiens
aaagtctgtttatctctgga

SEQ ID NO: 10047905 - DNA, 22 bp, Homo sapiens
aaagtctgagcagaatttctca

SEQ ID NO: 10047906 - DNA, 22 bp, Homo sapiens
aaagggcagagttcactagaaa

SEQ ID NO: 10047907 - DNA, 22 bp, Homo sapiens
aaaggctatgagatagaagata

SEQ ID NO: 10047908 - DNA, 22 bp, Homo sapiens
aaaggctcatgaaccaggctcg

SEQ ID NO: 10047909 - DNA, 22 bp, Homo sapiens
aaaggcatgattaattctgtgt

SEQ ID NO: 10047910 - DNA, 22 bp, Homo sapiens
aaattgtaggatcacatgacct

SEQ ID NO: 10047911 - DNA, 22 bp, Homo sapiens
aaattgtaatgacttcacttga

SEQ ID NO: 10047912 - DNA, 22 bp, Homo sapiens
aaagcatcagatctgacacttc

SEQ ID NO: 10047913 - DNA, 22 bp, Homo sapiens
aaagcatgttgggtccctcttt

SEQ ID NO: 10047914 - DNA, 22 bp, Homo sapiens
aaagcatttcatgtctagaaag

SEQ ID NO: 10047915 - DNA, 22 bp, Homo sapiens
aaaggataaggttatcaatttt

SEQ ID NO: 10047916 - DNA, 22 bp, Homo sapiens
aacatgaaacccaaacagaata

SEQ ID NO: 10047917 - DNA, 22 bp, Homo sapiens
aacatgaaacccaaacagaata

SEQ ID NO: 10047918 - DNA, 22 bp, Homo sapiens
aaaacagaggtgcctgggccca

SEQ ID NO: 10047919 - DNA, 22 bp, Homo sapiens
aaaacagacagccagtgtagag

SEQ ID NO: 10047920 - DNA, 22 bp, Homo sapiens
aaaacagacagccagtgtagag

SEQ ID NO: 10047921 - DNA, 22 bp, Homo sapiens
aaaacagacagccagtgtagag

SEQ ID NO: 10047922 - DNA, 22 bp, Homo sapiens
aaaacactgcaaagctgattgg

SEQ ID NO: 10047923 - DNA, 22 bp, Homo sapiens
aaaacagtttttgctaactgct

SEQ ID NO: 10047924 - DNA, 22 bp, Homo sapiens
aaaacagtttaggcatcacagt

SEQ ID NO: 10047925 - DNA, 22 bp, Homo sapiens
aaaagcagttatctgggaggaa

SEQ ID NO: 10047926 - DNA, 22 bp, Homo sapiens
aaaagctagtcaatgatgtatt

SEQ ID NO: 10047927 - DNA, 22 bp, Homo sapiens
aaaagcaattgcagttcttgcc

SEQ ID NO: 10047928 - DNA, 22 bp, Homo sapiens
aaaagcaagttgcctaggttga

SEQ ID NO: 10047929 - DNA, 22 bp, Homo sapiens
aaaacatgtccatacagaaact

SEQ ID NO: 10047930 - DNA, 22 bp, Homo sapiens
aaaaccacaatgacttttgcac

SEQ ID NO: 10047931 - DNA, 22 bp, Homo sapiens
aaaaccacaatgacttttgcag

SEQ ID NO: 10047932 - DNA, 22 bp, Homo sapiens
aaaaccacaattacttttgcac

SEQ ID NO: 10047933 - DNA, 22 bp, Homo sapiens
aaaaccacttccttgctattgg

SEQ ID NO: 10047934 - DNA, 22 bp, Homo sapiens
aaaaccacagttacttttgcac

SEQ ID NO: 10047935 - DNA, 22 bp, Homo sapiens
aaaacacaagaagcagggtaca

SEQ ID NO: 10047936 - DNA, 22 bp, Homo sapiens
aaaacacaagaagcagggtaca

SEQ ID NO: 10047937 - DNA, 20 bp, Homo sapiens
aaaaattgatatcgcttcct

SEQ ID NO: 10047938 - DNA, 22 bp, Homo sapiens
aaaaattgctgagaacggaatt

SEQ ID NO: 10047939 - DNA, 22 bp, Homo sapiens
aaaagagtgtttcaactttggc

SEQ ID NO: 10047940 - DNA, 22 bp, Homo sapiens
aaaagcaagttgcctaggttga

SEQ ID NO: 10047941 - DNA, 22 bp, Homo sapiens
aaaagcaaggcagtctgtctga

SEQ ID NO: 10047942 - DNA, 22 bp, Homo sapiens
aaaagtgttcaggaagaataat

SEQ ID NO: 10047943 - DNA, 21 bp, Homo sapiens
aaaaggaaggtctgtttgggg

SEQ ID NO: 10047944 - DNA, 22 bp, Homo sapiens
aaaatactactgtcttcttccc

SEQ ID NO: 10047945 - DNA, 22 bp, Homo sapiens
aaaatacacatactaggggaaa

SEQ ID NO: 10047946 - DNA, 22 bp, Homo sapiens
aaagcaatggatgagaatctgt

SEQ ID NO: 10047947 - DNA, 22 bp, Homo sapiens
aaaattggttcctttctgaggc

SEQ ID NO: 10047948 - DNA, 22 bp, Homo sapiens
aaaattgtaggaactgaatcaa

SEQ ID NO: 10047949 - DNA, 22 bp, Homo sapiens
aaaatgctgggaaagttggaat

SEQ ID NO: 10047950 - DNA, 22 bp, Homo sapiens
aaaatgctatttcatggaggag

SEQ ID NO: 10047951 - DNA, 22 bp, Homo sapiens
aaaatgctatttcatggaggag

SEQ ID NO: 10047952 - DNA, 22 bp, Homo sapiens
aaaatgcatgagaatgtgctcg

SEQ ID NO: 10047953 - DNA, 22 bp, Homo sapiens
aaataaactgaagcacagagag

SEQ ID NO: 10047954 - DNA, 22 bp, Homo sapiens
aaagtcattgctgttatcaatg

SEQ ID NO: 10047955 - DNA, 22 bp, Homo sapiens
aaagtcattggaatattaatga

SEQ ID NO: 10047956 - DNA, 22 bp, Homo sapiens
aaagtcattgtaatatatgcta

SEQ ID NO: 10047957 - DNA, 22 bp, Homo sapiens
aaagtcatccaaatttttatgt

SEQ ID NO: 10047958 - DNA, 22 bp, Homo sapiens
aaagtcatcatttcttttcaaa

SEQ ID NO: 10047959 - DNA, 22 bp, Homo sapiens
aaagtcatctaggagcagattt

SEQ ID NO: 10047960 - DNA, 22 bp, Homo sapiens
aaagtcatgatgaaccaccgta

SEQ ID NO: 10047961 - DNA, 22 bp, Homo sapiens
aaagtcatgcagttgaactttt

SEQ ID NO: 10047962 - DNA, 22 bp, Homo sapiens
aaagtcatgtaatgatatgatt

SEQ ID NO: 10047963 - DNA, 22 bp, Homo sapiens
aaagtcatggaaaatcttggaa

SEQ ID NO: 10047964 - DNA, 22 bp, Homo sapiens
aaagtacagatggtgaggttgg

SEQ ID NO: 10047965 - DNA, 22 bp, Homo sapiens
aaagtcatacatggtgcttact

SEQ ID NO: 10047966 - DNA, 22 bp, Homo sapiens
aaagtcatcagaaccttccaga

SEQ ID NO: 10047967 - DNA, 22 bp, Homo sapiens
aaagtacatgcaattcttctga

SEQ ID NO: 10047968 - DNA, 22 bp, Homo sapiens
aaagtacatagcatattccaac

SEQ ID NO: 10047969 - DNA, 22 bp, Homo sapiens
aaagctatgaggcatgcatttc

SEQ ID NO: 10047970 - DNA, 22 bp, Homo sapiens
aaaggacacacaggaggtgtct

SEQ ID NO: 10047971 - DNA, 22 bp, Homo sapiens
aaaggacatgtcaatatcaggc

SEQ ID NO: 10047972 - DNA, 22 bp, Homo sapiens
aaaggactggatattaaagagt

SEQ ID NO: 10047973 - DNA, 21 bp, Homo sapiens
aaatacagaaacttgttttca

SEQ ID NO: 10047974 - DNA, 21 bp, Homo sapiens
aaatacagatgcaaatctgtt

SEQ ID NO: 10047975 - DNA, 22 bp, Homo sapiens
aaatacacgtacatgtgtaaaa

SEQ ID NO: 10047976 - DNA, 22 bp, Homo sapiens
aaactgtgcttcccaaatgccc

SEQ ID NO: 10047977 - DNA, 23 bp, Homo sapiens
aaatgacatatggtttctgaagg

SEQ ID NO: 10047978 - DNA, 22 bp, Homo sapiens
aaatgacagttctctctgagta

SEQ ID NO: 10047979 - DNA, 22 bp, Homo sapiens
aaatgacagagtaagctgttta

SEQ ID NO: 10047980 - DNA, 22 bp, Homo sapiens
aaatgacagagtaagctgttta

SEQ ID NO: 10047981 - DNA, 22 bp, Homo sapiens
aaatgacagagctgggactagt

SEQ ID NO: 10047982 - DNA, 22 bp, Homo sapiens
aaatgacactcattcagtgtca

SEQ ID NO: 10047983 - DNA, 22 bp, Homo sapiens
aaatgacaataaaagtccatgc

SEQ ID NO: 10047984 - DNA, 22 bp, Homo sapiens
aaatgacactcattcagtgtca

SEQ ID NO: 10047985 - DNA, 22 bp, Homo sapiens
aaatgaacatcaagaatagcct

SEQ ID NO: 10047986 - DNA, 22 bp, Homo sapiens
aaatgaactcaatgatctccca

SEQ ID NO: 10047987 - DNA, 22 bp, Homo sapiens
aaatgtgagactgagttttcct

SEQ ID NO: 10047988 - DNA, 23 bp, Homo sapiens
aaatgtgagggaaaatctttctg

SEQ ID NO: 10047989 - DNA, 22 bp, Homo sapiens
aaagacacacagccagcaagtg

SEQ ID NO: 10047990 - DNA, 22 bp, Homo sapiens
aaagacacacagtgcttcagtt

SEQ ID NO: 10047991 - DNA, 22 bp, Homo sapiens
aaagacacacagccagcaagtg

SEQ ID NO: 10047992 - DNA, 22 bp, Homo sapiens
aaagacatatttctaagtttat

SEQ ID NO: 10047993 - DNA, 22 bp, Homo sapiens
aaagacacatgtctcttagatt

SEQ ID NO: 10047994 - DNA, 22 bp, Homo sapiens
aaagacacatgtctcttagatt

SEQ ID NO: 10047995 - DNA, 22 bp, Homo sapiens
aaagacacatatgcttaaccca

SEQ ID NO: 10047996 - DNA, 22 bp, Homo sapiens
aatcacaattacttttgcacca

SEQ ID NO: 10047997 - DNA, 22 bp, Homo sapiens
aatcacaaatgcaagttgtcac

SEQ ID NO: 10047998 - DNA, 22 bp, Homo sapiens
agaaagcttatgaatgggcaag

SEQ ID NO: 10047999 - DNA, 22 bp, Homo sapiens
agaaagctggaagagctgggat

SEQ ID NO: 10048000 - DNA, 22 bp, Homo sapiens
aatctaagccaccagtagtttc

SEQ ID NO: 10048001 - DNA, 22 bp, Homo sapiens
aatcgcttggtaattttaaaag

SEQ ID NO: 10048002 - DNA, 21 bp, Homo sapiens
aatccttaatgaggagttggt

SEQ ID NO: 10048003 - DNA, 22 bp, Homo sapiens
aatagcttagtcctgattctgt

SEQ ID NO: 10048004 - DNA, 22 bp, Homo sapiens
aatagctttctcatgacttcac

SEQ ID NO: 10048005 - DNA, 22 bp, Homo sapiens
aatagcttggacccattgcttt

SEQ ID NO: 10048006 - DNA, 22 bp, Homo sapiens
aatagcttattgacagtgaatt

SEQ ID NO: 10048007 - DNA, 22 bp, Homo sapiens
actttgcaaaaggaaatcacct

SEQ ID NO: 10048008 - DNA, 22 bp, Homo sapiens
acttttaaatgagtttcagttg

SEQ ID NO: 10048009 - DNA, 22 bp, Homo sapiens
acttttaaggggccttgattta

SEQ ID NO: 10048010 - DNA, 22 bp, Homo sapiens
agaagaaactgtcggggatatt

SEQ ID NO: 10048011 - DNA, 22 bp, Homo sapiens
agaacaattgccccaaagcttg

SEQ ID NO: 10048012 - DNA, 22 bp, Homo sapiens
aatgcattctcggtttgtgtgt

SEQ ID NO: 10048013 - DNA, 22 bp, Homo sapiens
aatgccttcaagtatctgagga

SEQ ID NO: 10048014 - DNA, 22 bp, Homo sapiens
aatgccaatgggcagaactaga

SEQ ID NO: 10048015 - DNA, 22 bp, Homo sapiens
aatgccaatgggcagaactaga

SEQ ID NO: 10048016 - DNA, 22 bp, Homo sapiens
aataatagcagagtttacaatc

SEQ ID NO: 10048017 - DNA, 22 bp, Homo sapiens
aataatacatgagattaatgtt

SEQ ID NO: 10048018 - DNA, 22 bp, Homo sapiens
aataatactgcatgtaaggtgc

SEQ ID NO: 10048019 - DNA, 22 bp, Homo sapiens
aataatacttcgtaaagttgtt

SEQ ID NO: 10048020 - DNA, 22 bp, Homo sapiens
aataaaatgaactggtagagtt

SEQ ID NO: 10048021 - DNA, 22 bp, Homo sapiens
aagtttttcacattgctgttgt

SEQ ID NO: 10048022 - DNA, 22 bp, Homo sapiens
actgggaggcatctggagctga

SEQ ID NO: 10048023 - DNA, 22 bp, Homo sapiens
actgggagggtcttgaagaggg

SEQ ID NO: 10048024 - DNA, 22 bp, Homo sapiens
actgggaggcaaagagcaagga

SEQ ID NO: 10048025 - DNA, 22 bp, Homo sapiens
aatagcatcctgtatctcttcc

SEQ ID NO: 10048026 - DNA, 22 bp, Homo sapiens
actgtccttttaatgcagccgt

SEQ ID NO: 10048027 - DNA, 22 bp, Homo sapiens
actgtaaggtaaggataaaacc

SEQ ID NO: 10048028 - DNA, 22 bp, Homo sapiens
actgtacacagtggtgtactgt

SEQ ID NO: 10048029 - DNA, 22 bp, Homo sapiens
actgtacacattcgtcaagact

SEQ ID NO: 10048030 - DNA, 22 bp, Homo sapiens
actcttttataaagcatcttga

SEQ ID NO: 10048031 - DNA, 18 bp, Homo sapiens
actctttctgcccacagg

SEQ ID NO: 10048032 - DNA, 22 bp, Homo sapiens
actcttgtctcaacttttgtat

SEQ ID NO: 10048033 - DNA, 22 bp, Homo sapiens
aagtgttaaagacttgaacact

SEQ ID NO: 10048034 - DNA, 22 bp, Homo sapiens
acctcctggcttatcatggaca

SEQ ID NO: 10048035 - DNA, 22 bp, Homo sapiens
acctcctggtgcccaagtgttt

SEQ ID NO: 10048036 - DNA, 22 bp, Homo sapiens
acctcctggctgctcatggaac

SEQ ID NO: 10048037 - DNA, 22 bp, Homo sapiens
acctcctggcctcaagcaatcc

SEQ ID NO: 10048038 - DNA, 22 bp, Homo sapiens
acccagggcagccagcggggag

SEQ ID NO: 10048039 - DNA, 22 bp, Homo sapiens
aagtagttagtccgcctgctct

SEQ ID NO: 10048040 - DNA, 22 bp, Homo sapiens
aagtagttggaaataagacaga

SEQ ID NO: 10048041 - DNA, 22 bp, Homo sapiens
aagtagttgtccctgaggaacg

SEQ ID NO: 10048042 - DNA, 22 bp, Homo sapiens
aagtcatagtcgggaaagacat

SEQ ID NO: 10048043 - DNA, 22 bp, Homo sapiens
aagtccagtttttccaggtggt

SEQ ID NO: 10048044 - DNA, 22 bp, Homo sapiens
aagtccagtttcatttgaggtc

SEQ ID NO: 10048045 - DNA, 22 bp, Homo sapiens
aagtccagtgctttagattcca

SEQ ID NO: 10048046 - DNA, 22 bp, Homo sapiens
aagtccttaggaagcagtcgtt

SEQ ID NO: 10048047 - DNA, 22 bp, Homo sapiens
aagtccttgtatacagaatcaa

SEQ ID NO: 10048048 - DNA, 22 bp, Homo sapiens
acatttcagaatcacacagctt

SEQ ID NO: 10048049 - DNA, 22 bp, Homo sapiens
acatttcagatgtaatgtgatg

SEQ ID NO: 10048050 - DNA, 22 bp, Homo sapiens
acatttcagcgtgcatgacatg

SEQ ID NO: 10048051 - DNA, 22 bp, Homo sapiens
acatttcagtaagtgttaattt

SEQ ID NO: 10048052 - DNA, 22 bp, Homo sapiens
acatttcagtgagctattgaag

SEQ ID NO: 10048053 - DNA, 22 bp, Homo sapiens
aagggggcggcagccagtggaa

SEQ ID NO: 10048054 - DNA, 22 bp, Homo sapiens
accagcaagattttgctttgca

SEQ ID NO: 10048055 - DNA, 22 bp, Homo sapiens
aagggggcccagcactaagttg

SEQ ID NO: 10048056 - DNA, 22 bp, Homo sapiens
aagggggcgaagacgtgattga

SEQ ID NO: 10048057 - DNA, 22 bp, Homo sapiens
aagggggccacacctggtgtga

SEQ ID NO: 10048058 - DNA, 22 bp, Homo sapiens
aagggggcacagtcactgtaat

SEQ ID NO: 10048059 - DNA, 20 bp, Homo sapiens
acatcctggtgactagaact

SEQ ID NO: 10048060 - DNA, 22 bp, Homo sapiens
acatcccatgcgcatctggcaa

SEQ ID NO: 10048061 - DNA, 22 bp, Homo sapiens
acatcccacagaaacatacata

SEQ ID NO: 10048062 - DNA, 22 bp, Homo sapiens
acatgaaatgcagcctgtaacc

SEQ ID NO: 10048063 - DNA, 22 bp, Homo sapiens
acatgaaatgcagcctgtaacc

SEQ ID NO: 10048064 - DNA, 22 bp, Homo sapiens
acatctcagaactgagtaaccg

SEQ ID NO: 10048065 - DNA, 22 bp, Homo sapiens
acatgacagtgcttagcaaact

SEQ ID NO: 10048066 - DNA, 22 bp, Homo sapiens
acatgcatacaagcacatgtag

SEQ ID NO: 10048067 - DNA, 22 bp, Homo sapiens
acatgacagtgcttagcaaact

SEQ ID NO: 10048068 - DNA, 22 bp, Homo sapiens
aaggccagagtactagaggctg

SEQ ID NO: 10048069 - DNA, 22 bp, Homo sapiens
aagctgttaatggcttgcagct

SEQ ID NO: 10048070 - DNA, 22 bp, Homo sapiens
aagctgtgtgactatttctgag

SEQ ID NO: 10048071 - DNA, 22 bp, Homo sapiens
aagctgtgtgcagatgatctca

SEQ ID NO: 10048072 - DNA, 22 bp, Homo sapiens
aagctgtgaaatctctagtgca

SEQ ID NO: 10048073 - DNA, 22 bp, Homo sapiens
aaggatcatagtaaacattgat

SEQ ID NO: 10048074 - DNA, 19 bp, Homo sapiens
aaggacacaacagagatag

SEQ ID NO: 10048075 - DNA, 22 bp, Homo sapiens
acaaatagagattcaaataaag

SEQ ID NO: 10048076 - DNA, 22 bp, Homo sapiens
acaaagtgtgcggagcccaggg

SEQ ID NO: 10048077 - DNA, 22 bp, Homo sapiens
acaaagtgttttctgaaggcct

SEQ ID NO: 10048078 - DNA, 22 bp, Homo sapiens
acaacagggtaaggcaggccat

SEQ ID NO: 10048079 - DNA, 18 bp, Homo sapiens
aatttctttgacaactta

SEQ ID NO: 10048080 - DNA, 22 bp, Homo sapiens
agagttaagacgtacatgagtg

SEQ ID NO: 10048081 - DNA, 22 bp, Homo sapiens
agagtgtaccaaatatcctaca

SEQ ID NO: 10048082 - DNA, 20 bp, Homo sapiens
agagtgggtgtcacaggctg

SEQ ID NO: 10048083 - DNA, 22 bp, Homo sapiens
agagtggtacttctttttcttc

SEQ ID NO: 10048084 - DNA, 22 bp, Homo sapiens
agcacaggtaatacagagtaac

SEQ ID NO: 10048085 - DNA, 22 bp, Homo sapiens
acacaacagaagagcaattgca

SEQ ID NO: 10048086 - DNA, 22 bp, Homo sapiens
acacaacagaagagcaattgca

SEQ ID NO: 10048087 - DNA, 22 bp, Homo sapiens
acacaacagaagagcaattgca

SEQ ID NO: 10048088 - DNA, 22 bp, Homo sapiens
acacaaattgtaggataattgc

SEQ ID NO: 10048089 - DNA, 22 bp, Homo sapiens
agcacaggctttggtgtgaggg

SEQ ID NO: 10048090 - DNA, 22 bp, Homo sapiens
agcacaggctttggtgtgaggg

SEQ ID NO: 10048091 - DNA, 22 bp, Homo sapiens
agcacagggacaatgccaggtg

SEQ ID NO: 10048092 - DNA, 22 bp, Homo sapiens
agcacacaggacttgattcatg

SEQ ID NO: 10048093 - DNA, 22 bp, Homo sapiens
agcaaagtagctgctgttctta

SEQ ID NO: 10048094 - DNA, 22 bp, Homo sapiens
agcaaagttaaggtttctcttt

SEQ ID NO: 10048095 - DNA, 22 bp, Homo sapiens
agcaaaagatagattaacaaga

SEQ ID NO: 10048096 - DNA, 20 bp, Homo sapiens
acaatacaggttgtgtctga

SEQ ID NO: 10048097 - DNA, 22 bp, Homo sapiens
aatgcctttccactgggtatca

SEQ ID NO: 10048098 - DNA, 22 bp, Homo sapiens
aatgctcaaaatgtttcatcta

SEQ ID NO: 10048099 - DNA, 22 bp, Homo sapiens
agacatcctggggagggcaatg

SEQ ID NO: 10048100 - DNA, 22 bp, Homo sapiens
aatgtattatacataatttgtg

SEQ ID NO: 10048101 - DNA, 22 bp, Homo sapiens
agaggatgttctaggcactcat

SEQ ID NO: 10048102 - DNA, 22 bp, Homo sapiens
aatttcaattacttttgcacca

SEQ ID NO: 10048103 - DNA, 22 bp, Homo sapiens
aatttcggttcaaggcccagtt

SEQ ID NO: 10048104 - DNA, 22 bp, Homo sapiens
agaggaggtccttttctgatgt

SEQ ID NO: 10048105 - DNA, 23 bp, Homo sapiens
aattacaaccaagaactggaagg

SEQ ID NO: 10048106 - DNA, 22 bp, Homo sapiens
aattccaaatcaactagtctag

SEQ ID NO: 10048107 - DNA, 22 bp, Homo sapiens
aattcattgccagaatctatga

SEQ ID NO: 10048108 - DNA, 22 bp, Homo sapiens
agagctgcagggtggacccagg

SEQ ID NO: 10048109 - DNA, 22 bp, Homo sapiens
agagctgcaatttcatgtggtg

SEQ ID NO: 10048110 - DNA, 22 bp, Homo sapiens
agagctgcccacacagcagatt

SEQ ID NO: 10048111 - DNA, 22 bp, Homo sapiens
agagctgccgagctggggccat

SEQ ID NO: 10048112 - DNA, 22 bp, Homo sapiens
agagctgatttgattacagtgc

SEQ ID NO: 10048113 - DNA, 22 bp, Homo sapiens
agagctgaggatccagctgagc

SEQ ID NO: 10048114 - DNA, 22 bp, Homo sapiens
agagctgaatttgggtggtgga

SEQ ID NO: 10048115 - DNA, 22 bp, Homo sapiens
agagctgagcaccaagcatggt

SEQ ID NO: 10048116 - DNA, 20 bp, Homo sapiens
agcggcagcttcctgcttcg

SEQ ID NO: 10048117 - DNA, 22 bp, Homo sapiens
agcgggctcacccggttgttgt

SEQ ID NO: 10048118 - DNA, 22 bp, Homo sapiens
agcgggctcaagtggccagcag

SEQ ID NO: 10048119 - DNA, 22 bp, Homo sapiens
agcgggtctgcaagccttccct

SEQ ID NO: 10048120 - DNA, 22 bp, Homo sapiens
agcgtatgaatatttgaagaga

SEQ ID NO: 10048121 - DNA, 22 bp, Homo sapiens
acagaatgcgtagtgcatgttg

SEQ ID NO: 10048122 - DNA, 22 bp, Homo sapiens
acagagctgtacatgtgccatg

SEQ ID NO: 10048123 - DNA, 22 bp, Homo sapiens
acagaggccatgagctgccacc

SEQ ID NO: 10048124 - DNA, 22 bp, Homo sapiens
acagcagattacattctgctat

SEQ ID NO: 10048125 - DNA, 22 bp, Homo sapiens
acagcagatgacaactatttat

SEQ ID NO: 10048126 - DNA, 22 bp, Homo sapiens
acagcagcatcctatttcactc

SEQ ID NO: 10048127 - DNA, 22 bp, Homo sapiens
acagcagatctggctacaggtt

SEQ ID NO: 10048128 - DNA, 22 bp, Homo sapiens
acagcagagtggagatgagcac

SEQ ID NO: 10048129 - DNA, 22 bp, Homo sapiens
acagcagagtgtgagatagcca

SEQ ID NO: 10048130 - DNA, 22 bp, Homo sapiens
acagcagagtgtgagatagcca

SEQ ID NO: 10048131 - DNA, 22 bp, Homo sapiens
agctgagcacattcaaacaggt

SEQ ID NO: 10048132 - DNA, 22 bp, Homo sapiens
agctgagattgtttccatttct

SEQ ID NO: 10048133 - DNA, 22 bp, Homo sapiens
agcaggctttccacagaaggag

SEQ ID NO: 10048134 - DNA, 22 bp, Homo sapiens
agcaggcttgttatgtctgaga

SEQ ID NO: 10048135 - DNA, 22 bp, Homo sapiens
acacatatgtggcaactgtaga

SEQ ID NO: 10048136 - DNA, 22 bp, Homo sapiens
acacatcagaaatatgaatgag

SEQ ID NO: 10048137 - DNA, 22 bp, Homo sapiens
acacaagattgtgtattgaatt

SEQ ID NO: 10048138 - DNA, 18 bp, Homo sapiens
acacacacacctgtgtat

SEQ ID NO: 10048139 - DNA, 22 bp, Homo sapiens
acacacacaagcaggttgtgga

SEQ ID NO: 10048140 - DNA, 22 bp, Homo sapiens
acacacacaagcaggttgtgga

SEQ ID NO: 10048141 - DNA, 18 bp, Homo sapiens
acacagtggatgcctggt

SEQ ID NO: 10048142 - DNA, 22 bp, Homo sapiens
agcaggtgtcactttcactcca

SEQ ID NO: 10048143 - DNA, 22 bp, Homo sapiens
agccaaggcagctagagctctg

SEQ ID NO: 10048144 - DNA, 22 bp, Homo sapiens
acacccagcttttgaatgccct

SEQ ID NO: 10048145 - DNA, 22 bp, Homo sapiens
acacccagattatgcacacaaa

SEQ ID NO: 10048146 - DNA, 22 bp, Homo sapiens
acacccagctgggccacctcca

SEQ ID NO: 10048147 - DNA, 20 bp, Homo sapiens
acactgttcttcacacattt

SEQ ID NO: 10048148 - DNA, 22 bp, Homo sapiens
agccaggaagaaggtcacacca

SEQ ID NO: 10048149 - DNA, 19 bp, Homo sapiens
tcattgaacataattactt

SEQ ID NO: 10048150 - DNA, 19 bp, Homo sapiens
tcattcaggaccagtggat

SEQ ID NO: 10048151 - DNA, 22 bp, Homo sapiens
tcattcagagagaatgttccag

SEQ ID NO: 10048152 - DNA, 22 bp, Homo sapiens
tcatggccaaagtcaggagtgt

SEQ ID NO: 10048153 - DNA, 22 bp, Homo sapiens
tcatataagtttaaaactatct

SEQ ID NO: 10048154 - DNA, 22 bp, Homo sapiens
tcatagatgtgctgtgcacaaa

SEQ ID NO: 10048155 - DNA, 22 bp, Homo sapiens
tcatatgattgtaatgagaata

SEQ ID NO: 10048156 - DNA, 22 bp, Homo sapiens
tcagtctttgcttatgacaata

SEQ ID NO: 10048157 - DNA, 22 bp, Homo sapiens
tcagtctttttctcttaagtac

SEQ ID NO: 10048158 - DNA, 19 bp, Homo sapiens
tcaggagttagttgtgctc

SEQ ID NO: 10048159 - DNA, 22 bp, Homo sapiens
tcaggagtaaagacagagttcc

SEQ ID NO: 10048160 - DNA, 18 bp, Homo sapiens
tcagcctgttgtctgcct

SEQ ID NO: 10048161 - DNA, 21 bp, Homo sapiens
tcagcagaaagcaaggtcagt

SEQ ID NO: 10048162 - DNA, 21 bp, Homo sapiens
tcagcaggcaccagaaggctg

SEQ ID NO: 10048163 - DNA, 22 bp, Homo sapiens
tcacagctggacacgttggcat

SEQ ID NO: 10048164 - DNA, 22 bp, Homo sapiens
tcacagctccagactgcaactc

SEQ ID NO: 10048165 - DNA, 22 bp, Homo sapiens
tcacaagatacagttagaagca

SEQ ID NO: 10048166 - DNA, 22 bp, Homo sapiens
tcacaaaaggccatgtggcttc

SEQ ID NO: 10048167 - DNA, 22 bp, Homo sapiens
tcacaaaagcttttgaatttgg

SEQ ID NO: 10048168 - DNA, 22 bp, Homo sapiens
tatttcttgagactcgtcttcc

SEQ ID NO: 10048169 - DNA, 22 bp, Homo sapiens
tcaagacatcactgtgcatttt

SEQ ID NO: 10048170 - DNA, 22 bp, Homo sapiens
tcaataatggcaggataaattt

SEQ ID NO: 10048171 - DNA, 22 bp, Homo sapiens
tcaatttatgtggctattcatt

SEQ ID NO: 10048172 - DNA, 22 bp, Homo sapiens
tcacccaggatattgaagtcag

SEQ ID NO: 10048173 - DNA, 22 bp, Homo sapiens
tcacccaggctggtatgcagtg

SEQ ID NO: 10048174 - DNA, 22 bp, Homo sapiens
tcaccaaggcattttcacagca

SEQ ID NO: 10048175 - DNA, 22 bp, Homo sapiens
tcaccagacagttactgcatgt

SEQ ID NO: 10048176 - DNA, 23 bp, Homo sapiens
tcaccagaaggggtcaataaaga

SEQ ID NO: 10048177 - DNA, 22 bp, Homo sapiens
tcaccaggattcctatcagtag

SEQ ID NO: 10048178 - DNA, 22 bp, Homo sapiens
tcaccagatgatttttcttcag

SEQ ID NO: 10048179 - DNA, 22 bp, Homo sapiens
tcaccagatctctctgtaatgg

SEQ ID NO: 10048180 - DNA, 22 bp, Homo sapiens
tcaccaggattgggctgtaggc

SEQ ID NO: 10048181 - DNA, 23 bp, Homo sapiens
tcagagaggccccctgcagagat

SEQ ID NO: 10048182 - DNA, 22 bp, Homo sapiens
tcagagcagactttgaaggagg

SEQ ID NO: 10048183 - DNA, 20 bp, Homo sapiens
tcagagcagttggcttgtct

SEQ ID NO: 10048184 - DNA, 22 bp, Homo sapiens
tcagagcatgtgggctgcagtt

SEQ ID NO: 10048185 - DNA, 22 bp, Homo sapiens
tcagagaagctgccaggcgagc

SEQ ID NO: 10048186 - DNA, 23 bp, Homo sapiens
tcagagaactcgggcagatgacc

SEQ ID NO: 10048187 - DNA, 23 bp, Homo sapiens
tcagagaactcgggcagatgacc

SEQ ID NO: 10048188 - DNA, 22 bp, Homo sapiens
tcagacatatttttaacaaagt

SEQ ID NO: 10048189 - DNA, 22 bp, Homo sapiens
tcagaaaagagaaaatcttata

SEQ ID NO: 10048190 - DNA, 22 bp, Homo sapiens
tcagaaaagagaaaatcttata

SEQ ID NO: 10048191 - DNA, 21 bp, Homo sapiens
tcccaagctgctggctcagct

SEQ ID NO: 10048192 - DNA, 22 bp, Homo sapiens
tcccaagccctggatgcctcag

SEQ ID NO: 10048193 - DNA, 22 bp, Homo sapiens
tcccaagcttagggctctcagt

SEQ ID NO: 10048194 - DNA, 21 bp, Homo sapiens
tcccacagcgccagctcctgt

SEQ ID NO: 10048195 - DNA, 22 bp, Homo sapiens
tccaggagtcagacagatggtg

SEQ ID NO: 10048196 - DNA, 22 bp, Homo sapiens
tccaggagtcctgggtggcccc

SEQ ID NO: 10048197 - DNA, 22 bp, Homo sapiens
tccaggagtcctgggtggcccc

SEQ ID NO: 10048198 - DNA, 22 bp, Homo sapiens
tccaggagggttttctgccttc

SEQ ID NO: 10048199 - DNA, 22 bp, Homo sapiens
tccaggaggtatgagtggcccc

SEQ ID NO: 10048200 - DNA, 22 bp, Homo sapiens
tccaggaggtgaggggaccaaa

SEQ ID NO: 10048201 - DNA, 20 bp, Homo sapiens
tccagacatctagctcagtt

SEQ ID NO: 10048202 - DNA, 18 bp, Homo sapiens
tccagagagggagaagtg

SEQ ID NO: 10048203 - DNA, 19 bp, Homo sapiens
tccagaagtccctgagcgg

SEQ ID NO: 10048204 - DNA, 22 bp, Homo sapiens
tccagagaggtttctccatgct

SEQ ID NO: 10048205 - DNA, 22 bp, Homo sapiens
tcattgaatttcacagctttat

SEQ ID NO: 10048206 - DNA, 22 bp, Homo sapiens
tccagagatctctcttccctgt

SEQ ID NO: 10048207 - DNA, 22 bp, Homo sapiens
tccagagatcacactgggcagg

SEQ ID NO: 10048208 - DNA, 22 bp, Homo sapiens
tccagagatcacactgggcagg

SEQ ID NO: 10048209 - DNA, 20 bp, Homo sapiens
tccagagagtggcaaagctc

SEQ ID NO: 10048210 - DNA, 23 bp, Homo sapiens
tccagcagccaagaagggtagaa

SEQ ID NO: 10048211 - DNA, 18 bp, Homo sapiens
tccagcagcatagtttcc

SEQ ID NO: 10048212 - DNA, 22 bp, Homo sapiens
tccagcagagtctctgaggggg

SEQ ID NO: 10048213 - DNA, 18 bp, Homo sapiens
tccagcaggtctgaggtg

SEQ ID NO: 10048214 - DNA, 22 bp, Homo sapiens
tccagcagccacacctctggac

SEQ ID NO: 10048215 - DNA, 22 bp, Homo sapiens
tccagctctggcttggctagct

SEQ ID NO: 10048216 - DNA, 21 bp, Homo sapiens
tccagctcttatgttcatgaa

SEQ ID NO: 10048217 - DNA, 22 bp, Homo sapiens
tccagctctgctgtgcgccggt

SEQ ID NO: 10048218 - DNA, 18 bp, Homo sapiens
tccagctctgccacttac

SEQ ID NO: 10048219 - DNA, 22 bp, Homo sapiens
tccagctcctgagttcactgct

SEQ ID NO: 10048220 - DNA, 22 bp, Homo sapiens
tccagctctaaggctgatagcc

SEQ ID NO: 10048221 - DNA, 22 bp, Homo sapiens
tccagctctaacatgctgggcc

SEQ ID NO: 10048222 - DNA, 22 bp, Homo sapiens
tccagcaggttggtcaggtgca

SEQ ID NO: 10048223 - DNA, 19 bp, Homo sapiens
tccagcagtgcttgaaatc

SEQ ID NO: 10048224 - DNA, 22 bp, Homo sapiens
tccagctcaaagtgctcctgtc

SEQ ID NO: 10048225 - DNA, 22 bp, Homo sapiens
tccagctcacagatagcgtggg

SEQ ID NO: 10048226 - DNA, 18 bp, Homo sapiens
tccagctcacagatgggc

SEQ ID NO: 10048227 - DNA, 18 bp, Homo sapiens
tccagctcacagatgggc

SEQ ID NO: 10048228 - DNA, 22 bp, Homo sapiens
tccagctcagggttggctcaag

SEQ ID NO: 10048229 - DNA, 22 bp, Homo sapiens
tccagctcccactctcactgct

SEQ ID NO: 10048230 - DNA, 23 bp, Homo sapiens
tccagctcccttcaatggcactg

SEQ ID NO: 10048231 - DNA, 17 bp, Homo sapiens
tccagctcctcattgtt

SEQ ID NO: 10048232 - DNA, 22 bp, Homo sapiens
tccagctcctctacccgatgcg

SEQ ID NO: 10048233 - DNA, 20 bp, Homo sapiens
tccagctccgtgttcttcct

SEQ ID NO: 10048234 - DNA, 17 bp, Homo sapiens
tccagctcctcattgtt

SEQ ID NO: 10048235 - DNA, 22 bp, Homo sapiens
tccagctcatctgtctccatta

SEQ ID NO: 10048236 - DNA, 19 bp, Homo sapiens
tccccaagagttctagctc

SEQ ID NO: 10048237 - DNA, 22 bp, Homo sapiens
tcccacagcttcgtgcttcccc

SEQ ID NO: 10048238 - DNA, 22 bp, Homo sapiens
tcccagtttttctccactaagg

SEQ ID NO: 10048239 - DNA, 22 bp, Homo sapiens
tagacacatcttcatccacaat

SEQ ID NO: 10048240 - DNA, 22 bp, Homo sapiens
tagagggccagctggacagcga

SEQ ID NO: 10048241 - DNA, 22 bp, Homo sapiens
tagaggggaaaatgcgtattaa

SEQ ID NO: 10048242 - DNA, 22 bp, Homo sapiens
tagacacaaatctcagtgacac

SEQ ID NO: 10048243 - DNA, 22 bp, Homo sapiens
tagacacaaatctcagtgacac

SEQ ID NO: 10048244 - DNA, 22 bp, Homo sapiens
tagaaaagataacattctgtgc

SEQ ID NO: 10048245 - DNA, 22 bp, Homo sapiens
tagaaaactaatacatgcttga

SEQ ID NO: 10048246 - DNA, 22 bp, Homo sapiens
tagaaaactaatacatgcttga

SEQ ID NO: 10048247 - DNA, 22 bp, Homo sapiens
tactttttgtctctttgaatgt

SEQ ID NO: 10048248 - DNA, 22 bp, Homo sapiens
tactttgcagcttgataaaatg

SEQ ID NO: 10048249 - DNA, 22 bp, Homo sapiens
tactttggatccttacaatagc

SEQ ID NO: 10048250 - DNA, 22 bp, Homo sapiens
tacattttctaggggaccaaga

SEQ ID NO: 10048251 - DNA, 22 bp, Homo sapiens
taccaaaaccaagccattatct

SEQ ID NO: 10048252 - DNA, 22 bp, Homo sapiens
taccaaaagcttgtttcataca

SEQ ID NO: 10048253 - DNA, 22 bp, Homo sapiens
tagaaacacagatctggtgtca

SEQ ID NO: 10048254 - DNA, 22 bp, Homo sapiens
tagaaacaatgacatgcttgta

SEQ ID NO: 10048255 - DNA, 22 bp, Homo sapiens
tagaaacaatgacatgcttgta

SEQ ID NO: 10048256 - DNA, 22 bp, Homo sapiens
tagaaacatcagctaaccaaaa

SEQ ID NO: 10048257 - DNA, 22 bp, Homo sapiens
tagagggttattaggacagaag

SEQ ID NO: 10048258 - DNA, 22 bp, Homo sapiens
tagaggtgttcattctctccat

SEQ ID NO: 10048259 - DNA, 23 bp, Homo sapiens
tagcagcatttttagcctctgtc

SEQ ID NO: 10048260 - DNA, 22 bp, Homo sapiens
tagccccagctactcggaagct

SEQ ID NO: 10048261 - DNA, 22 bp, Homo sapiens
tagctcttgccagatcctcgat

SEQ ID NO: 10048262 - DNA, 22 bp, Homo sapiens
tagctcttcaatcactgtctcc

SEQ ID NO: 10048263 - DNA, 22 bp, Homo sapiens
taggaaaatatctcttattggg

SEQ ID NO: 10048264 - DNA, 22 bp, Homo sapiens
tagctttgcctgttaatcacaa

SEQ ID NO: 10048265 - DNA, 22 bp, Homo sapiens
tagctttgcctgaagtaatcag

SEQ ID NO: 10048266 - DNA, 22 bp, Homo sapiens
tagctttgttagaatgtcttca

SEQ ID NO: 10048267 - DNA, 22 bp, Homo sapiens
taggaaaacgtgattttctcac

SEQ ID NO: 10048268 - DNA, 22 bp, Homo sapiens
taggcactgaccttctcagatt

SEQ ID NO: 10048269 - DNA, 22 bp, Homo sapiens
taggcactgggctaggacaggt

SEQ ID NO: 10048270 - DNA, 22 bp, Homo sapiens
taggcaatgttctaaggaatga

SEQ ID NO: 10048271 - DNA, 22 bp, Homo sapiens
taggcactggttgtggatagtt

SEQ ID NO: 10048272 - DNA, 22 bp, Homo sapiens
tatatcaccaaaaacagttctg

SEQ ID NO: 10048273 - DNA, 22 bp, Homo sapiens
tatagttagtttcataatcatg

SEQ ID NO: 10048274 - DNA, 22 bp, Homo sapiens
tatagcaattcagaatacatgt

SEQ ID NO: 10048275 - DNA, 22 bp, Homo sapiens
tatgagaaaggagaatgacttt

SEQ ID NO: 10048276 - DNA, 22 bp, Homo sapiens
tatgagaacaagaacaatctcc

SEQ ID NO: 10048277 - DNA, 22 bp, Homo sapiens
tatacaatggctgaatcatcca

SEQ ID NO: 10048278 - DNA, 22 bp, Homo sapiens
tatacacacctccaaagcagga

SEQ ID NO: 10048279 - DNA, 22 bp, Homo sapiens
tatacacaaggtgtgcatttgt

SEQ ID NO: 10048280 - DNA, 22 bp, Homo sapiens
tatacaagtaatgctgaatgat

SEQ ID NO: 10048281 - DNA, 22 bp, Homo sapiens
tatacaatgagtacattctggg

SEQ ID NO: 10048282 - DNA, 22 bp, Homo sapiens
tatacacatcctccaaagatag

SEQ ID NO: 10048283 - DNA, 22 bp, Homo sapiens
tatacacatgtgtgtattcata

SEQ ID NO: 10048284 - DNA, 22 bp, Homo sapiens
tatacacatttttacctatagt

SEQ ID NO: 10048285 - DNA, 22 bp, Homo sapiens
tataacaggaagtattcaaaca

SEQ ID NO: 10048286 - DNA, 20 bp, Homo sapiens
tataacagtgttgggtgtgt

SEQ ID NO: 10048287 - DNA, 22 bp, Homo sapiens
tataactgagaagatacatagt

SEQ ID NO: 10048288 - DNA, 22 bp, Homo sapiens
taggtctgatttccattcagtc

SEQ ID NO: 10048289 - DNA, 22 bp, Homo sapiens
taggtgggtgacttccatgggg

SEQ ID NO: 10048290 - DNA, 21 bp, Homo sapiens
taggtgggagccccagtatgc

SEQ ID NO: 10048291 - DNA, 22 bp, Homo sapiens
tattctcagcaacacacatgga

SEQ ID NO: 10048292 - DNA, 22 bp, Homo sapiens
tatttataacagtgagaacggg

SEQ ID NO: 10048293 - DNA, 22 bp, Homo sapiens
tatttataccaggtgatcggag

SEQ ID NO: 10048294 - DNA, 22 bp, Homo sapiens
tatttataatctgccaaagaga

SEQ ID NO: 10048295 - DNA, 22 bp, Homo sapiens
tattagaaaggctattgcatag

SEQ ID NO: 10048296 - DNA, 19 bp, Homo sapiens
tatgtgtgcatttgtgcat

SEQ ID NO: 10048297 - DNA, 22 bp, Homo sapiens
tatgagctttggaatgagaaac

SEQ ID NO: 10048298 - DNA, 22 bp, Homo sapiens
taaattactcaatgcacataaa

SEQ ID NO: 10048299 - DNA, 22 bp, Homo sapiens
taaattaccctttagggaattg

SEQ ID NO: 10048300 - DNA, 23 bp, Homo sapiens
taaattacctttccagtgcaggg

SEQ ID NO: 10048301 - DNA, 22 bp, Homo sapiens
taactagaatggctattttgag

SEQ ID NO: 10048302 - DNA, 22 bp, Homo sapiens
taactagaagaatgcaccaaga

SEQ ID NO: 10048303 - DNA, 22 bp, Homo sapiens
taactgaatgtattacaacaga

SEQ ID NO: 10048304 - DNA, 22 bp, Homo sapiens
taactgatattgaaaaacatca

SEQ ID NO: 10048305 - DNA, 22 bp, Homo sapiens
taactgaacatctcaaatcaag

SEQ ID NO: 10048306 - DNA, 22 bp, Homo sapiens
taactgaacagcctaattcttt

SEQ ID NO: 10048307 - DNA, 22 bp, Homo sapiens
taactccatctctgtgtctgct

SEQ ID NO: 10048308 - DNA, 22 bp, Homo sapiens
taactccacacccctcttggtg

SEQ ID NO: 10048309 - DNA, 22 bp, Homo sapiens
taaattgttttctagaagttgt

SEQ ID NO: 10048310 - DNA, 22 bp, Homo sapiens
taaattgtgtgttgctagggga

SEQ ID NO: 10048311 - DNA, 22 bp, Homo sapiens
gtttccatggaagcaaaggtgg

SEQ ID NO: 10048312 - DNA, 22 bp, Homo sapiens
gttttcttcctgcaattggcat

SEQ ID NO: 10048313 - DNA, 22 bp, Homo sapiens
gttttgaatcactgcgcttcac

SEQ ID NO: 10048314 - DNA, 22 bp, Homo sapiens
gttttgaagaagaccttgaaac

SEQ ID NO: 10048315 - DNA, 18 bp, Homo sapiens
gttttgaattgtcttaca

SEQ ID NO: 10048316 - DNA, 22 bp, Homo sapiens
taaaattgcggtgaatatttcc

SEQ ID NO: 10048317 - DNA, 22 bp, Homo sapiens
taaaggcttttagtgatggtaa

SEQ ID NO: 10048318 - DNA, 22 bp, Homo sapiens
taaacagaatgcgtaagaagtg

SEQ ID NO: 10048319 - DNA, 22 bp, Homo sapiens
taaacagaatgcgtaagaagtg

SEQ ID NO: 10048320 - DNA, 22 bp, Homo sapiens
taaacagaaagcagatgtactt

SEQ ID NO: 10048321 - DNA, 22 bp, Homo sapiens
taaaatgcacagcagttgaaag

SEQ ID NO: 10048322 - DNA, 22 bp, Homo sapiens
gtgctccctccttcctcaagga

SEQ ID NO: 10048323 - DNA, 22 bp, Homo sapiens
gtgctcagggcctggctgggga

SEQ ID NO: 10048324 - DNA, 22 bp, Homo sapiens
gtgctcaggttcccatgagtgc

SEQ ID NO: 10048325 - DNA, 22 bp, Homo sapiens
gtgctccctccttcctcaagga

SEQ ID NO: 10048326 - DNA, 22 bp, Homo sapiens
gtgctccctccttcctcaagga

SEQ ID NO: 10048327 - DNA, 22 bp, Homo sapiens
gttaagaatcaagacttatctt

SEQ ID NO: 10048328 - DNA, 22 bp, Homo sapiens
gtgtgggaaggctaggatgctg

SEQ ID NO: 10048329 - DNA, 22 bp, Homo sapiens
gtgtgggaatggcggtcgtgca

SEQ ID NO: 10048330 - DNA, 22 bp, Homo sapiens
gttgtacagcatccagtgcaga

SEQ ID NO: 10048331 - DNA, 22 bp, Homo sapiens
gttgtacagcatccagtgcaga

SEQ ID NO: 10048332 - DNA, 22 bp, Homo sapiens
gttcagttttgaaatgttaatt

SEQ ID NO: 10048333 - DNA, 18 bp, Homo sapiens
gttcatctttttctaaag

SEQ ID NO: 10048334 - DNA, 22 bp, Homo sapiens
gttcagtttgacaacctttata

SEQ ID NO: 10048335 - DNA, 22 bp, Homo sapiens
gttcagttatgtgacctcaaaa

SEQ ID NO: 10048336 - DNA, 22 bp, Homo sapiens
tacatagtgaacatttacagag

SEQ ID NO: 10048337 - DNA, 22 bp, Homo sapiens
tacagtaagatgaaatagcaat

SEQ ID NO: 10048338 - DNA, 22 bp, Homo sapiens
tacagtaatctggacatgattt

SEQ ID NO: 10048339 - DNA, 22 bp, Homo sapiens
tacatagaacatgtttaatgtc

SEQ ID NO: 10048340 - DNA, 22 bp, Homo sapiens
tacaggcactgaaatgcttatt

SEQ ID NO: 10048341 - DNA, 20 bp, Homo sapiens
tacaggagtgagtgggtggg

SEQ ID NO: 10048342 - DNA, 19 bp, Homo sapiens
tacaggaggcctgcaatct

SEQ ID NO: 10048343 - DNA, 22 bp, Homo sapiens
tacaggagcacaaaagagttga

SEQ ID NO: 10048344 - DNA, 22 bp, Homo sapiens
tacaggagcatggggaagggat

SEQ ID NO: 10048345 - DNA, 20 bp, Homo sapiens
tacagaaacaggacttttgg

SEQ ID NO: 10048346 - DNA, 22 bp, Homo sapiens
tacactttttactacagattct

SEQ ID NO: 10048347 - DNA, 20 bp, Homo sapiens
tacaacaagtagagacatac

SEQ ID NO: 10048348 - DNA, 22 bp, Homo sapiens
tacaacaatttccacattagaa

SEQ ID NO: 10048349 - DNA, 22 bp, Homo sapiens
tacagaaatcacatcgctttga

SEQ ID NO: 10048350 - DNA, 22 bp, Homo sapiens
tacagaataaagcgtgaagctt

SEQ ID NO: 10048351 - DNA, 22 bp, Homo sapiens
taatacatcattcatctaagga

SEQ ID NO: 10048352 - DNA, 22 bp, Homo sapiens
taatacattacctaacctctct

SEQ ID NO: 10048353 - DNA, 22 bp, Homo sapiens
taatacatgtattccagagagt

SEQ ID NO: 10048354 - DNA, 22 bp, Homo sapiens
taagtgagctagcagaagtgac

SEQ ID NO: 10048355 - DNA, 22 bp, Homo sapiens
taatggcagagtcatgctttct

SEQ ID NO: 10048356 - DNA, 22 bp, Homo sapiens
taatagaatagtggaaacattg

SEQ ID NO: 10048357 - DNA, 22 bp, Homo sapiens
taattacaggtccaaaacaatc

SEQ ID NO: 10048358 - DNA, 22 bp, Homo sapiens
taattacagaggtttgccagtt

SEQ ID NO: 10048359 - DNA, 22 bp, Homo sapiens
taattacaaagcaagcacaggg

SEQ ID NO: 10048360 - DNA, 22 bp, Homo sapiens
taattataacagttacatctta

SEQ ID NO: 10048361 - DNA, 22 bp, Homo sapiens
taattatacaaaaaggcatgca

SEQ ID NO: 10048362 - DNA, 22 bp, Homo sapiens
tacaaaaaattgatactgacga

SEQ ID NO: 10048363 - DNA, 22 bp, Homo sapiens
tacaaagtaatgtataatatcg

SEQ ID NO: 10048364 - DNA, 22 bp, Homo sapiens
gctttggagtcagaaagaccta

SEQ ID NO: 10048365 - DNA, 22 bp, Homo sapiens
ggaagaggctgaggccatgctg

SEQ ID NO: 10048366 - DNA, 22 bp, Homo sapiens
gctttggaacttaaatccttgg

SEQ ID NO: 10048367 - DNA, 22 bp, Homo sapiens
gctttgcttccttccccttcaa

SEQ ID NO: 10048368 - DNA, 22 bp, Homo sapiens
gctttgctggcttgaaatgctg

SEQ ID NO: 10048369 - DNA, 22 bp, Homo sapiens
gctttgctagcactgcgcttcc

SEQ ID NO: 10048370 - DNA, 22 bp, Homo sapiens
gctttgctatgactcaccagca

SEQ ID NO: 10048371 - DNA, 17 bp, Homo sapiens
ggacacagctcatggct

SEQ ID NO: 10048372 - DNA, 22 bp, Homo sapiens
ggaagagggaaccacgactgta

SEQ ID NO: 10048373 - DNA, 22 bp, Homo sapiens
ggaagatgagaagtggggctcc

SEQ ID NO: 10048374 - DNA, 22 bp, Homo sapiens
ggagacagtatggcttgtagct

SEQ ID NO: 10048375 - DNA, 19 bp, Homo sapiens
ggaccaggtcctgggcagc

SEQ ID NO: 10048376 - DNA, 22 bp, Homo sapiens
ggaccaggctgagcacctgcct

SEQ ID NO: 10048377 - DNA, 22 bp, Homo sapiens
ggaccaggctgagcacctgcct

SEQ ID NO: 10048378 - DNA, 22 bp, Homo sapiens
ggaccaggcaagctgaggcggg

SEQ ID NO: 10048379 - DNA, 22 bp, Homo sapiens
ggaccaggagctcagagccctc

SEQ ID NO: 10048380 - DNA, 22 bp, Homo sapiens
ggacaggtgtgaggctggcaca

SEQ ID NO: 10048381 - DNA, 22 bp, Homo sapiens
ggacacaggtaaataccactga

SEQ ID NO: 10048382 - DNA, 22 bp, Homo sapiens
ggacacagggctcactctctct

SEQ ID NO: 10048383 - DNA, 22 bp, Homo sapiens
ggagcagcactgccacacagag

SEQ ID NO: 10048384 - DNA, 22 bp, Homo sapiens
ggagcagatgtcttcatggcct

SEQ ID NO: 10048385 - DNA, 22 bp, Homo sapiens
ggagagaatctgaacctgctcc

SEQ ID NO: 10048386 - DNA, 22 bp, Homo sapiens
ggagacttgagtttttgtctta

SEQ ID NO: 10048387 - DNA, 22 bp, Homo sapiens
gctgtgtatcagatgccacggg

SEQ ID NO: 10048388 - DNA, 22 bp, Homo sapiens
gctgtgtacctactaactgctt

SEQ ID NO: 10048389 - DNA, 22 bp, Homo sapiens
gctggggcctgaacagtcagct

SEQ ID NO: 10048390 - DNA, 22 bp, Homo sapiens
gctggggcctgaacagtcagct

SEQ ID NO: 10048391 - DNA, 22 bp, Homo sapiens
gctgtgggtttccaatcctgga

SEQ ID NO: 10048392 - DNA, 22 bp, Homo sapiens
gctgtggcggcagcagctggtg

SEQ ID NO: 10048393 - DNA, 22 bp, Homo sapiens
gctgggcttcacctccagagtt

SEQ ID NO: 10048394 - DNA, 22 bp, Homo sapiens
gctgggaacacagccatgagag

SEQ ID NO: 10048395 - DNA, 22 bp, Homo sapiens
gctggcttgtcccaggacaaag

SEQ ID NO: 10048396 - DNA, 21 bp, Homo sapiens
gctggctggctgaccggcctt

SEQ ID NO: 10048397 - DNA, 22 bp, Homo sapiens
gctggctgtgttccttctgcca

SEQ ID NO: 10048398 - DNA, 22 bp, Homo sapiens
gctggagaaactgcagctgagg

SEQ ID NO: 10048399 - DNA, 22 bp, Homo sapiens
gctggagacctcagagaaccca

SEQ ID NO: 10048400 - DNA, 22 bp, Homo sapiens
gctggagaaactgcagctgagg

SEQ ID NO: 10048401 - DNA, 22 bp, Homo sapiens
gctgctttagaattgaaacaga

SEQ ID NO: 10048402 - DNA, 22 bp, Homo sapiens
gctggagaaacaggaggaggaa

SEQ ID NO: 10048403 - DNA, 22 bp, Homo sapiens
gctggctgcgtcatcacagggc

SEQ ID NO: 10048404 - DNA, 22 bp, Homo sapiens
gctggctgctaggacagctaca

SEQ ID NO: 10048405 - DNA, 22 bp, Homo sapiens
gctggctggaatgggagaagaa

SEQ ID NO: 10048406 - DNA, 19 bp, Homo sapiens
gctggctggaggagggaca

SEQ ID NO: 10048407 - DNA, 22 bp, Homo sapiens
gctcctctcccagagctgcagg

SEQ ID NO: 10048408 - DNA, 22 bp, Homo sapiens
gctctgggaactgactgccttc

SEQ ID NO: 10048409 - DNA, 17 bp, Homo sapiens
gctgagaaggggaagag

SEQ ID NO: 10048410 - DNA, 22 bp, Homo sapiens
gctgagaatgttcctactggta

SEQ ID NO: 10048411 - DNA, 22 bp, Homo sapiens
gctgccctgtctgcagcaggac

SEQ ID NO: 10048412 - DNA, 22 bp, Homo sapiens
gctgccgttggctcttcaggcc

SEQ ID NO: 10048413 - DNA, 22 bp, Homo sapiens
gctgcttcagggacgtgccagc

SEQ ID NO: 10048414 - DNA, 22 bp, Homo sapiens
gctgctcatttgtatcctttgt

SEQ ID NO: 10048415 - DNA, 20 bp, Homo sapiens
gctgcgatccgtttcacagt

SEQ ID NO: 10048416 - DNA, 22 bp, Homo sapiens
gctgcctgtctgtttcttttat

SEQ ID NO: 10048417 - DNA, 22 bp, Homo sapiens
gctgcctgtgcactttctcgta

SEQ ID NO: 10048418 - DNA, 22 bp, Homo sapiens
gctgcctgtggcccttctgggt

SEQ ID NO: 10048419 - DNA, 22 bp, Homo sapiens
gctcccagaaccaaggctgggg

SEQ ID NO: 10048420 - DNA, 22 bp, Homo sapiens
gcctttatccctgtacaaggtg

SEQ ID NO: 10048421 - DNA, 22 bp, Homo sapiens
gcctttatcttgggccaagttt

SEQ ID NO: 10048422 - DNA, 22 bp, Homo sapiens
gcgggtggaacggctccacgtg

SEQ ID NO: 10048423 - DNA, 22 bp, Homo sapiens
gcgtcttttagattttacatct

SEQ ID NO: 10048424 - DNA, 22 bp, Homo sapiens
gcctctggtccctcatgctgtg

SEQ ID NO: 10048425 - DNA, 23 bp, Homo sapiens
gccttggcgatccgtggggcatc

SEQ ID NO: 10048426 - DNA, 22 bp, Homo sapiens
gccttgccgctcagcagtgggg

SEQ ID NO: 10048427 - DNA, 22 bp, Homo sapiens
gcagcctcaaactccccagctc

SEQ ID NO: 10048428 - DNA, 22 bp, Homo sapiens
gcagcctcagggcactcagatg

SEQ ID NO: 10048429 - DNA, 22 bp, Homo sapiens
gcagctttctaagctttattgc

SEQ ID NO: 10048430 - DNA, 22 bp, Homo sapiens
gcagctgtcatttacaacaggg

SEQ ID NO: 10048431 - DNA, 22 bp, Homo sapiens
gcagcctccgcactgcgagtcc

SEQ ID NO: 10048432 - DNA, 19 bp, Homo sapiens
gcaggaaatgagtgattgc

SEQ ID NO: 10048433 - DNA, 22 bp, Homo sapiens
gcaggaaaggttgagactttgc

SEQ ID NO: 10048434 - DNA, 18 bp, Homo sapiens
gcagcccctcttccttcc

SEQ ID NO: 10048435 - DNA, 22 bp, Homo sapiens
gcagccccaggagacgcccagg

SEQ ID NO: 10048436 - DNA, 22 bp, Homo sapiens
gcagccccaggagacgcccagg

SEQ ID NO: 10048437 - DNA, 22 bp, Homo sapiens
gcagggacagggcagggccttt

SEQ ID NO: 10048438 - DNA, 22 bp, Homo sapiens
gcagggacatcttcagatcact

SEQ ID NO: 10048439 - DNA, 22 bp, Homo sapiens
gcagggaccagggccagatcca

SEQ ID NO: 10048440 - DNA, 22 bp, Homo sapiens
gcagggcttgcagcagctagac

SEQ ID NO: 10048441 - DNA, 22 bp, Homo sapiens
gcaggcagaggtggaggagaca

SEQ ID NO: 10048442 - DNA, 22 bp, Homo sapiens
gcaggcagatcacctgtcagga

SEQ ID NO: 10048443 - DNA, 20 bp, Homo sapiens
gcagagtgtgagagggtgaa

SEQ ID NO: 10048444 - DNA, 22 bp, Homo sapiens
gcagagggtcctgtgccagcag

SEQ ID NO: 10048445 - DNA, 22 bp, Homo sapiens
gcagagggtcctgtgccagcag

SEQ ID NO: 10048446 - DNA, 22 bp, Homo sapiens
gcagaccagcccctggagctgc

SEQ ID NO: 10048447 - DNA, 22 bp, Homo sapiens
gcagagaacccagcagattggc

SEQ ID NO: 10048448 - DNA, 22 bp, Homo sapiens
gcagagcaccctgcagtggtat

SEQ ID NO: 10048449 - DNA, 18 bp, Homo sapiens
gcagagcagaagctcaag

SEQ ID NO: 10048450 - DNA, 19 bp, Homo sapiens
gcacaccctgcaccaccat

SEQ ID NO: 10048451 - DNA, 22 bp, Homo sapiens
gcacacagtactatatgctaca

SEQ ID NO: 10048452 - DNA, 22 bp, Homo sapiens
gcaaagcaatcaggagtagcat

SEQ ID NO: 10048453 - DNA, 21 bp, Homo sapiens
gcaaagtgtgggcataaacag

SEQ ID NO: 10048454 - DNA, 22 bp, Homo sapiens
gcaaaggccactggggcgatgg

SEQ ID NO: 10048455 - DNA, 22 bp, Homo sapiens
gcaaaggctagagacacaggga

SEQ ID NO: 10048456 - DNA, 22 bp, Homo sapiens
gcaaaggcttcttttattctcc

SEQ ID NO: 10048457 - DNA, 22 bp, Homo sapiens
gcatgcagtaaaattcagcaac

SEQ ID NO: 10048458 - DNA, 22 bp, Homo sapiens
gcatggccttgctgtagtggta

SEQ ID NO: 10048459 - DNA, 22 bp, Homo sapiens
gcagtggcatgatgtgggctca

SEQ ID NO: 10048460 - DNA, 22 bp, Homo sapiens
gcagtggccacatggaggagga

SEQ ID NO: 10048461 - DNA, 22 bp, Homo sapiens
gcatgcagggagggtctggctg

SEQ ID NO: 10048462 - DNA, 22 bp, Homo sapiens
gcatgcaggagagaaagacggc

SEQ ID NO: 10048463 - DNA, 22 bp, Homo sapiens
gcatgcagaaaatgaacaacga

SEQ ID NO: 10048464 - DNA, 22 bp, Homo sapiens
gcagtgctttagtctgtccttt

SEQ ID NO: 10048465 - DNA, 22 bp, Homo sapiens
gcagtggcagctgagggggtat

SEQ ID NO: 10048466 - DNA, 22 bp, Homo sapiens
gcagtggcagagacagcaccaa

SEQ ID NO: 10048467 - DNA, 20 bp, Homo sapiens
gccagccctgacacaggagc

SEQ ID NO: 10048468 - DNA, 22 bp, Homo sapiens
gccagctcccaagtgagcccct

SEQ ID NO: 10048469 - DNA, 22 bp, Homo sapiens
gccagctccgcaggatggcgcg

SEQ ID NO: 10048470 - DNA, 22 bp, Homo sapiens
gccagctctgtggctgtacttg

SEQ ID NO: 10048471 - DNA, 23 bp, Homo sapiens
gccagccttgctctcctgcagcc

SEQ ID NO: 10048472 - DNA, 22 bp, Homo sapiens
gccagctcagatgcaggaagga

SEQ ID NO: 10048473 - DNA, 22 bp, Homo sapiens
gccagctcagatgcaggaagga

SEQ ID NO: 10048474 - DNA, 22 bp, Homo sapiens
gccagctcagtgccaggcccct

SEQ ID NO: 10048475 - DNA, 22 bp, Homo sapiens
gcccagccctgaggtcacagct

SEQ ID NO: 10048476 - DNA, 22 bp, Homo sapiens
gcccagcctccaagctccaagg

SEQ ID NO: 10048477 - DNA, 22 bp, Homo sapiens
gcccagctcctctgcagaccct

SEQ ID NO: 10048478 - DNA, 22 bp, Homo sapiens
gcccagcacctctctcagggtt

SEQ ID NO: 10048479 - DNA, 22 bp, Homo sapiens
gcccagcacctctctcagggtt

SEQ ID NO: 10048480 - DNA, 22 bp, Homo sapiens
gccagggttcgaatccgtatgg

SEQ ID NO: 10048481 - DNA, 22 bp, Homo sapiens
gccaggggtgcccacccaagga

SEQ ID NO: 10048482 - DNA, 22 bp, Homo sapiens
gcccagcacatctggccttgaa

SEQ ID NO: 10048483 - DNA, 22 bp, Homo sapiens
gcccagcacattgctgaggacc

SEQ ID NO: 10048484 - DNA, 22 bp, Homo sapiens
gcccagctttttgaggcaggca

SEQ ID NO: 10048485 - DNA, 22 bp, Homo sapiens
gccccagcctgggaactggagg

SEQ ID NO: 10048486 - DNA, 22 bp, Homo sapiens
gccccagccaaggtgacacgaa

SEQ ID NO: 10048487 - DNA, 22 bp, Homo sapiens
gccccagaaagttcaaggcaca

SEQ ID NO: 10048488 - DNA, 22 bp, Homo sapiens
gccccagcctcccgagtagctg

SEQ ID NO: 10048489 - DNA, 22 bp, Homo sapiens
gccccagccaaggtgacacgaa

SEQ ID NO: 10048490 - DNA, 22 bp, Homo sapiens
gccctgggattgggtggaggct

SEQ ID NO: 10048491 - DNA, 22 bp, Homo sapiens
gcctccggagtcacagtgtctt

SEQ ID NO: 10048492 - DNA, 22 bp, Homo sapiens
gcctccggagttgcagtgtctt

SEQ ID NO: 10048493 - DNA, 22 bp, Homo sapiens
gcctcctgaagtgctgggatta

SEQ ID NO: 10048494 - DNA, 22 bp, Homo sapiens
gcctcctgaaaggaagagctcc

SEQ ID NO: 10048495 - DNA, 22 bp, Homo sapiens
gcctcctgacttacactgagct

SEQ ID NO: 10048496 - DNA, 22 bp, Homo sapiens
gcctcctggattttagtgccat

SEQ ID NO: 10048497 - DNA, 22 bp, Homo sapiens
gcctcctgagtagctgggattg

SEQ ID NO: 10048498 - DNA, 22 bp, Homo sapiens
gcctcctgcccagatgagtgat

SEQ ID NO: 10048499 - DNA, 22 bp, Homo sapiens
gcctcctggggtgccatcatct

SEQ ID NO: 10048500 - DNA, 22 bp, Homo sapiens
gcctcctggcctttgctcctca

SEQ ID NO: 10048501 - DNA, 22 bp, Homo sapiens
ggccaatgggaatggccagtag

SEQ ID NO: 10048502 - DNA, 22 bp, Homo sapiens
ggccagtcccctaatccagggc

SEQ ID NO: 10048503 - DNA, 22 bp, Homo sapiens
ggccagggcctggggactgtcc

SEQ ID NO: 10048504 - DNA, 22 bp, Homo sapiens
ggcaggtggaagttggcagagc

SEQ ID NO: 10048505 - DNA, 22 bp, Homo sapiens
ggccatggcgggagccggcgtc

SEQ ID NO: 10048506 - DNA, 22 bp, Homo sapiens
ggcctctgttctgcattcctcc

SEQ ID NO: 10048507 - DNA, 22 bp, Homo sapiens
ggcctgagtcacatcaggagag

SEQ ID NO: 10048508 - DNA, 22 bp, Homo sapiens
ggcaaaagtattatctctttaa

SEQ ID NO: 10048509 - DNA, 22 bp, Homo sapiens
ggagccagagcactggggagcc

SEQ ID NO: 10048510 - DNA, 22 bp, Homo sapiens
ggagccagagcactggggagcc

SEQ ID NO: 10048511 - DNA, 19 bp, Homo sapiens
ggagccagctgtggaaggc

SEQ ID NO: 10048512 - DNA, 22 bp, Homo sapiens
ggcagaggagctggaaacatgg

SEQ ID NO: 10048513 - DNA, 22 bp, Homo sapiens
ggcagaggaagctggaagtggg

SEQ ID NO: 10048514 - DNA, 23 bp, Homo sapiens
ggcaccaggccatggagcgggag

SEQ ID NO: 10048515 - DNA, 22 bp, Homo sapiens
ggcagaggtagctggaaccagg

SEQ ID NO: 10048516 - DNA, 20 bp, Homo sapiens
ggcagagggcctgggagaag

SEQ ID NO: 10048517 - DNA, 22 bp, Homo sapiens
ggcagaggtagctggaaccagg

SEQ ID NO: 10048518 - DNA, 22 bp, Homo sapiens
ggctctttggcgggccttgaac

SEQ ID NO: 10048519 - DNA, 22 bp, Homo sapiens
ggctctggagatgtccgacctg

SEQ ID NO: 10048520 - DNA, 22 bp, Homo sapiens
ggctctggagcacagacgtctg

SEQ ID NO: 10048521 - DNA, 22 bp, Homo sapiens
ggctccagatgtcccctggcaa

SEQ ID NO: 10048522 - DNA, 22 bp, Homo sapiens
ggctccagaggccttacctgca

SEQ ID NO: 10048523 - DNA, 22 bp, Homo sapiens
ggctccaggagggccttggcca

SEQ ID NO: 10048524 - DNA, 22 bp, Homo sapiens
ggctccagatgtctcctggcaa

SEQ ID NO: 10048525 - DNA, 22 bp, Homo sapiens
ggctccaggaacctcctctcct

SEQ ID NO: 10048526 - DNA, 22 bp, Homo sapiens
ggctgggcaggtctgcacaggg

SEQ ID NO: 10048527 - DNA, 22 bp, Homo sapiens
ggctgggcatccatccatgaga

SEQ ID NO: 10048528 - DNA, 22 bp, Homo sapiens
ggctgctgcccacccctgcatg

SEQ ID NO: 10048529 - DNA, 22 bp, Homo sapiens
ggctgctgagtcacgacagtga

SEQ ID NO: 10048530 - DNA, 19 bp, Homo sapiens
ggctgctgaagagaattac

SEQ ID NO: 10048531 - DNA, 22 bp, Homo sapiens
ggctgctgacaaacatgatcat

SEQ ID NO: 10048532 - DNA, 22 bp, Homo sapiens
ggctgggaggatgacttgctac

SEQ ID NO: 10048533 - DNA, 22 bp, Homo sapiens
ggctggcttgcggagtcacaga

SEQ ID NO: 10048534 - DNA, 22 bp, Homo sapiens
ggctggcttggtgagctgtcac

SEQ ID NO: 10048535 - DNA, 22 bp, Homo sapiens
ggctgggaggccgtgctgacct

SEQ ID NO: 10048536 - DNA, 22 bp, Homo sapiens
ggctgctggcctctccccggcc

SEQ ID NO: 10048537 - DNA, 22 bp, Homo sapiens
ggctgctggccagcctaggagt

SEQ ID NO: 10048538 - DNA, 22 bp, Homo sapiens
ggctgctggagttgggtctctc

SEQ ID NO: 10048539 - DNA, 22 bp, Homo sapiens
gggcaggctgagcatgtcacct

SEQ ID NO: 10048540 - DNA, 23 bp, Homo sapiens
gggcatggagtgtaggtggaagg

SEQ ID NO: 10048541 - DNA, 22 bp, Homo sapiens
gggcagctgcccctctctgggc

SEQ ID NO: 10048542 - DNA, 22 bp, Homo sapiens
gggcagctgccaagtgcatcgc

SEQ ID NO: 10048543 - DNA, 22 bp, Homo sapiens
gggcagctgcagggatggtgac

SEQ ID NO: 10048544 - DNA, 22 bp, Homo sapiens
gggcacagcccagtggggtccc

SEQ ID NO: 10048545 - DNA, 19 bp, Homo sapiens
gggcacagcctccccccag

SEQ ID NO: 10048546 - DNA, 22 bp, Homo sapiens
gggatggggtcaacatgtacct

SEQ ID NO: 10048547 - DNA, 22 bp, Homo sapiens
gggatggggtcgggaccctgct

SEQ ID NO: 10048548 - DNA, 22 bp, Homo sapiens
gggaggaaatgtgcagcgaatt

SEQ ID NO: 10048549 - DNA, 22 bp, Homo sapiens
gggaggaaagagaagtggtcca

SEQ ID NO: 10048550 - DNA, 22 bp, Homo sapiens
gggagaggttacccgagcaact

SEQ ID NO: 10048551 - DNA, 22 bp, Homo sapiens
gggagaggttacccgagcaact

SEQ ID NO: 10048552 - DNA, 22 bp, Homo sapiens
gggagctgtagtccagataccg

SEQ ID NO: 10048553 - DNA, 22 bp, Homo sapiens
gggagagcgggaggtgccacag

SEQ ID NO: 10048554 - DNA, 22 bp, Homo sapiens
gggagagaattattgccagacc

SEQ ID NO: 10048555 - DNA, 22 bp, Homo sapiens
gggagacacgctgcaggcataa

SEQ ID NO: 10048556 - DNA, 22 bp, Homo sapiens
gggacatgaagcatcggaggca

SEQ ID NO: 10048557 - DNA, 22 bp, Homo sapiens
gggacatctttctagtcagggt

SEQ ID NO: 10048558 - DNA, 22 bp, Homo sapiens
gggacatggaggcgcgcaggca

SEQ ID NO: 10048559 - DNA, 22 bp, Homo sapiens
gggacagctgtagtgcttggct

SEQ ID NO: 10048560 - DNA, 22 bp, Homo sapiens
gtgaagagctgttgcagagatt

SEQ ID NO: 10048561 - DNA, 22 bp, Homo sapiens
gtgaaatgaatctggaaatatt

SEQ ID NO: 10048562 - DNA, 22 bp, Homo sapiens
gtgaaaataaggctggttcttg

SEQ ID NO: 10048563 - DNA, 22 bp, Homo sapiens
gtctgctgcagagcatggcttt

SEQ ID NO: 10048564 - DNA, 22 bp, Homo sapiens
gtctgcctggaggcagctgctg

SEQ ID NO: 10048565 - DNA, 22 bp, Homo sapiens
gtctgctggtgcctggcctgcg

SEQ ID NO: 10048566 - DNA, 22 bp, Homo sapiens
gtctgctggtgcctggcctgcg

SEQ ID NO: 10048567 - DNA, 22 bp, Homo sapiens
gtctgctgtgggtccccaggag

SEQ ID NO: 10048568 - DNA, 22 bp, Homo sapiens
gtctgctggcacgtcacagata

SEQ ID NO: 10048569 - DNA, 22 bp, Homo sapiens
gtctgctgcagtcgtggctcta

SEQ ID NO: 10048570 - DNA, 22 bp, Homo sapiens
gtctgccctgcagacatgcctc

SEQ ID NO: 10048571 - DNA, 22 bp, Homo sapiens
gtgcagtgtgtaatccaggaac

SEQ ID NO: 10048572 - DNA, 20 bp, Homo sapiens
gtgcatttcacctgtactgt

SEQ ID NO: 10048573 - DNA, 22 bp, Homo sapiens
gtgcatttatatttgcctttgg

SEQ ID NO: 10048574 - DNA, 22 bp, Homo sapiens
gtgcagtgaccctggagagctg

SEQ ID NO: 10048575 - DNA, 22 bp, Homo sapiens
gtattattgtcatgaaataata

SEQ ID NO: 10048576 - DNA, 22 bp, Homo sapiens
gtagaaatggtgtgtttcttct

SEQ ID NO: 10048577 - DNA, 22 bp, Homo sapiens
gtatttaattccattaagttag

SEQ ID NO: 10048578 - DNA, 22 bp, Homo sapiens
gtattcagtttgattgtctaca

SEQ ID NO: 10048579 - DNA, 22 bp, Homo sapiens
gtattcatttatttactcatcc

SEQ ID NO: 10048580 - DNA, 22 bp, Homo sapiens
gtattcagaaggatgatctagt

SEQ ID NO: 10048581 - DNA, 22 bp, Homo sapiens
gtattcagggctagtcagagga

SEQ ID NO: 10048582 - DNA, 22 bp, Homo sapiens
gtacatttctcccaacactaaa

SEQ ID NO: 10048583 - DNA, 22 bp, Homo sapiens
gtacatttctcttgttcttatt

SEQ ID NO: 10048584 - DNA, 22 bp, Homo sapiens
gtacatttctcccaacactaaa

SEQ ID NO: 10048585 - DNA, 22 bp, Homo sapiens
gtacatttctcttgttcttatt

SEQ ID NO: 10048586 - DNA, 22 bp, Homo sapiens
gtacattttactttgtttgaat

SEQ ID NO: 10048587 - DNA, 22 bp, Homo sapiens
gtacattttgaggttaaaacaa

SEQ ID NO: 10048588 - DNA, 22 bp, Homo sapiens
gtacattttgaggttaaaacaa

SEQ ID NO: 10048589 - DNA, 22 bp, Homo sapiens
gtacatttaggattcattgaaa

SEQ ID NO: 10048590 - DNA, 22 bp, Homo sapiens
gtaaaactgcagaacttggagg

SEQ ID NO: 10048591 - DNA, 22 bp, Homo sapiens
gtacatttcagtttccttaaga

SEQ ID NO: 10048592 - DNA, 22 bp, Homo sapiens
gtacatttcagtttccttaaga

SEQ ID NO: 10048593 - DNA, 22 bp, Homo sapiens
gtacatttcatttaaatgatgt

SEQ ID NO: 10048594 - DNA, 22 bp, Homo sapiens
ggtttgttggggtccaggccca

SEQ ID NO: 10048595 - DNA, 22 bp, Homo sapiens
gtccccgacgtttggcttgatg

SEQ ID NO: 10048596 - DNA, 22 bp, Homo sapiens
gtccccagctgtgacgagagcc

SEQ ID NO: 10048597 - DNA, 19 bp, Homo sapiens
gtatttcaggacaagacgt

SEQ ID NO: 10048598 - DNA, 22 bp, Homo sapiens
gtatttcatcttgaaaaccagt

SEQ ID NO: 10048599 - DNA, 22 bp, Homo sapiens
gtccaagagtcaagaagggggc

SEQ ID NO: 10048600 - DNA, 18 bp, Homo sapiens
gtccacagattcttcact

SEQ ID NO: 10048601 - DNA, 22 bp, Homo sapiens
gtccccagaaaggtgaggcagg

SEQ ID NO: 10048602 - DNA, 22 bp, Homo sapiens
ggtctctttgcttcagctacag

SEQ ID NO: 10048603 - DNA, 22 bp, Homo sapiens
ggtggccttttatgagcagggt

SEQ ID NO: 10048604 - DNA, 18 bp, Homo sapiens
ggtggcggggatggaggt

SEQ ID NO: 10048605 - DNA, 19 bp, Homo sapiens
ggtggctcagggcccagcc

SEQ ID NO: 10048606 - DNA, 22 bp, Homo sapiens
ggtgttgcagttgaagactggt

SEQ ID NO: 10048607 - DNA, 22 bp, Homo sapiens
ggtgttaacttgtttatgacaa

SEQ ID NO: 10048608 - DNA, 19 bp, Homo sapiens
ggtgtgtgctggggcctgt

SEQ ID NO: 10048609 - DNA, 22 bp, Homo sapiens
ggtgtgtgaggagtcacttagt

SEQ ID NO: 10048610 - DNA, 22 bp, Homo sapiens
ggtgtggtttgaagggagatgg

SEQ ID NO: 10048611 - DNA, 22 bp, Homo sapiens
ggtgtgtgaggagtcacttagt

SEQ ID NO: 10048612 - DNA, 22 bp, Homo sapiens
ggtgtgtggtcctctcacttag

SEQ ID NO: 10048613 - DNA, 22 bp, Homo sapiens
ggtggctctcttaagggcagcg

SEQ ID NO: 10048614 - DNA, 22 bp, Homo sapiens
ggtggctctccctggactcagc

SEQ ID NO: 10048615 - DNA, 17 bp, Homo sapiens
ggtggctcgggcgcggc

SEQ ID NO: 10048616 - DNA, 22 bp, Homo sapiens
ggtggctcggccagtgcaggcc

SEQ ID NO: 10048617 - DNA, 22 bp, Homo sapiens
ggtcgctgtgtaggttcagcta

SEQ ID NO: 10048618 - DNA, 22 bp, Homo sapiens
ggtcgctgtgtaggttcagcta

SEQ ID NO: 10048619 - DNA, 22 bp, Homo sapiens
ggtccttcagtaggttccagac

SEQ ID NO: 10048620 - DNA, 22 bp, Homo sapiens
ggtctccagctgggaccctgca

SEQ ID NO: 10048621 - DNA, 22 bp, Homo sapiens
ggtctccaaagcttaggactac

SEQ ID NO: 10048622 - DNA, 22 bp, Homo sapiens
ggtctccaaagctgcattgatg

SEQ ID NO: 10048623 - DNA, 22 bp, Homo sapiens
ggtcacgtgaccgcacctgcct

SEQ ID NO: 10048624 - DNA, 19 bp, Homo sapiens
ggtcagagagatccaggct

SEQ ID NO: 10048625 - DNA, 22 bp, Homo sapiens
gggtggcacaggtgcagagggt

SEQ ID NO: 10048626 - DNA, 22 bp, Homo sapiens
gggtggcagctgttgccaaggt

SEQ ID NO: 10048627 - DNA, 22 bp, Homo sapiens
ggggctccagtcttcacatttt

SEQ ID NO: 10048628 - DNA, 22 bp, Homo sapiens
ggggccgaccgcggttcaggcc

SEQ ID NO: 10048629 - DNA, 22 bp, Homo sapiens
ggggtgggcgtgcagggacacc

SEQ ID NO: 10048630 - DNA, 22 bp, Homo sapiens
gggctgagagctggaatctgag

SEQ ID NO: 10048631 - DNA, 22 bp, Homo sapiens
gggctgagctgttctgagttta

SEQ ID NO: 10048632 - DNA, 22 bp, Homo sapiens
gggctgagctaagctgggttga

SEQ ID NO: 10048633 - DNA, 22 bp, Homo sapiens
ctgggagctagctctgagctga

SEQ ID NO: 10048634 - DNA, 22 bp, Homo sapiens
ctgggaggattcattgaggtga

SEQ ID NO: 10048635 - DNA, 22 bp, Homo sapiens
ctgggcatggacagctgcacag

SEQ ID NO: 10048636 - DNA, 22 bp, Homo sapiens
ctgggcatgaaaaggatgccag

SEQ ID NO: 10048637 - DNA, 22 bp, Homo sapiens
ctgggaggcccacgttgggaag

SEQ ID NO: 10048638 - DNA, 22 bp, Homo sapiens
ctgggaggcagaggttgcagtg

SEQ ID NO: 10048639 - DNA, 22 bp, Homo sapiens
ctgggaggcagaggttgtagtg

SEQ ID NO: 10048640 - DNA, 20 bp, Homo sapiens
ctgggctgcccagctatggg

SEQ ID NO: 10048641 - DNA, 22 bp, Homo sapiens
ctggcctgtcctgacccagcct

SEQ ID NO: 10048642 - DNA, 22 bp, Homo sapiens
ctggctggaagttagagaactt

SEQ ID NO: 10048643 - DNA, 22 bp, Homo sapiens
ctggctggaacgccgaggcggc

SEQ ID NO: 10048644 - DNA, 22 bp, Homo sapiens
ctgccagaaggttcctgctgca

SEQ ID NO: 10048645 - DNA, 22 bp, Homo sapiens
ctgccaagtaatgcctgggctc

SEQ ID NO: 10048646 - DNA, 22 bp, Homo sapiens
ctgcatccatgttgctgcaaag

SEQ ID NO: 10048647 - DNA, 22 bp, Homo sapiens
ctgcatcattttcagacaatgg

SEQ ID NO: 10048648 - DNA, 22 bp, Homo sapiens
ctgccacaggggagcaggcaga

SEQ ID NO: 10048649 - DNA, 22 bp, Homo sapiens
ctgccacaggggagcaggcaga

SEQ ID NO: 10048650 - DNA, 22 bp, Homo sapiens
ctgccacaggggagcaggcaga

SEQ ID NO: 10048651 - DNA, 22 bp, Homo sapiens
ctggcagccaagtgggatactc

SEQ ID NO: 10048652 - DNA, 22 bp, Homo sapiens
ctgtgtcttctgcttacagtct

SEQ ID NO: 10048653 - DNA, 22 bp, Homo sapiens
ctgttacaagagagagacatga

SEQ ID NO: 10048654 - DNA, 22 bp, Homo sapiens
ctgttgctctgaacaggtcttg

SEQ ID NO: 10048655 - DNA, 22 bp, Homo sapiens
ctgttgcttcaggaaacagtaa

SEQ ID NO: 10048656 - DNA, 22 bp, Homo sapiens
ctgttgcatgactgtgcatgct

SEQ ID NO: 10048657 - DNA, 22 bp, Homo sapiens
ctgttctgtctcatgttgcaca

SEQ ID NO: 10048658 - DNA, 22 bp, Homo sapiens
ctgttctgtaagctgctgttgt

SEQ ID NO: 10048659 - DNA, 22 bp, Homo sapiens
ctgttctgaccagtgcagggat

SEQ ID NO: 10048660 - DNA, 22 bp, Homo sapiens
ctgttctgctgcataaaaactt

SEQ ID NO: 10048661 - DNA, 22 bp, Homo sapiens
ctgttctggagacactgatgaa

SEQ ID NO: 10048662 - DNA, 22 bp, Homo sapiens
ctgttcttctagtccactgaca

SEQ ID NO: 10048663 - DNA, 22 bp, Homo sapiens
ctgttctttagttccactgcaa

SEQ ID NO: 10048664 - DNA, 22 bp, Homo sapiens
ctgttctgaactgcctgcatgc

SEQ ID NO: 10048665 - DNA, 22 bp, Homo sapiens
ctgttcatggaaaaatagttgg

SEQ ID NO: 10048666 - DNA, 18 bp, Homo sapiens
ctgttcagctgaactaca

SEQ ID NO: 10048667 - DNA, 22 bp, Homo sapiens
ctgttcagtaacctataaaaca

SEQ ID NO: 10048668 - DNA, 22 bp, Homo sapiens
ctgttcagatggcacattcagt

SEQ ID NO: 10048669 - DNA, 22 bp, Homo sapiens
ctgtggctctccaatggaggga

SEQ ID NO: 10048670 - DNA, 22 bp, Homo sapiens
ctgtggtggcacagcgggctgg

SEQ ID NO: 10048671 - DNA, 22 bp, Homo sapiens
ctgtgccaggcccagctgactt

SEQ ID NO: 10048672 - DNA, 22 bp, Homo sapiens
ctgtggccagtcccacacctcc

SEQ ID NO: 10048673 - DNA, 22 bp, Homo sapiens
ctgtggctcatatctgtaatct

SEQ ID NO: 10048674 - DNA, 22 bp, Homo sapiens
ctgtgcattgtcttgtctgtag

SEQ ID NO: 10048675 - DNA, 22 bp, Homo sapiens
ctgtccctgagcaactcctgtt

SEQ ID NO: 10048676 - DNA, 22 bp, Homo sapiens
ctgggtgaatttgaaggaaagg

SEQ ID NO: 10048677 - DNA, 22 bp, Homo sapiens
ctgggtgagctggccagagggt

SEQ ID NO: 10048678 - DNA, 22 bp, Homo sapiens
ctgtcctgatggtgccactggt

SEQ ID NO: 10048679 - DNA, 22 bp, Homo sapiens
ctgtcctggggaaagccagccc

SEQ ID NO: 10048680 - DNA, 22 bp, Homo sapiens
cttcagcctcatctcagcccgt

SEQ ID NO: 10048681 - DNA, 22 bp, Homo sapiens
cttcagcctcaactactatggt

SEQ ID NO: 10048682 - DNA, 22 bp, Homo sapiens
cttcagccctgagtgccagcag

SEQ ID NO: 10048683 - DNA, 22 bp, Homo sapiens
cttcagctcttggtaaatgttt

SEQ ID NO: 10048684 - DNA, 22 bp, Homo sapiens
cttcagcctcgttactcctgcg

SEQ ID NO: 10048685 - DNA, 22 bp, Homo sapiens
cttcagtgattgcagaaagcct

SEQ ID NO: 10048686 - DNA, 22 bp, Homo sapiens
ctgttgtcttcattgtcatatc

SEQ ID NO: 10048687 - DNA, 22 bp, Homo sapiens
ctgttgtctcctctcagattat

SEQ ID NO: 10048688 - DNA, 22 bp, Homo sapiens
ctgttgtccctgggagctcagc

SEQ ID NO: 10048689 - DNA, 22 bp, Homo sapiens
cttatattttaggaacagacaa

SEQ ID NO: 10048690 - DNA, 22 bp, Homo sapiens
cttatattttaggaacagacaa

SEQ ID NO: 10048691 - DNA, 22 bp, Homo sapiens
cttatattttaggaacagacaa

SEQ ID NO: 10048692 - DNA, 22 bp, Homo sapiens
cttatcagattatctgggctgt

SEQ ID NO: 10048693 - DNA, 22 bp, Homo sapiens
cttatatttgtcaactttacaa

SEQ ID NO: 10048694 - DNA, 22 bp, Homo sapiens
cttcaaacactagaaacacagg

SEQ ID NO: 10048695 - DNA, 22 bp, Homo sapiens
cttcagaagagttaagtgtgag

SEQ ID NO: 10048696 - DNA, 22 bp, Homo sapiens
cttcagcccagcctccgcctcc

SEQ ID NO: 10048697 - DNA, 22 bp, Homo sapiens
cttcagccagctggggatgcgg

SEQ ID NO: 10048698 - DNA, 22 bp, Homo sapiens
cttcagaaccagccagaagagg

SEQ ID NO: 10048699 - DNA, 20 bp, Homo sapiens
cttgtacatgataaagattt

SEQ ID NO: 10048700 - DNA, 22 bp, Homo sapiens
cttgtattcttccacttaagat

SEQ ID NO: 10048701 - DNA, 22 bp, Homo sapiens
cttgtattcttgtacctttcaa

SEQ ID NO: 10048702 - DNA, 22 bp, Homo sapiens
cttgtattctgcctaaccttca

SEQ ID NO: 10048703 - DNA, 22 bp, Homo sapiens
cttgtattaagcttagagaggc

SEQ ID NO: 10048704 - DNA, 22 bp, Homo sapiens
cttgtattaggaagaatgcttt

SEQ ID NO: 10048705 - DNA, 22 bp, Homo sapiens
cttgtattatggttcgcttagt

SEQ ID NO: 10048706 - DNA, 22 bp, Homo sapiens
cttgtattaagcttagagaggc

SEQ ID NO: 10048707 - DNA, 22 bp, Homo sapiens
cttgtattaggaagaatgcttt

SEQ ID NO: 10048708 - DNA, 22 bp, Homo sapiens
cttgtattcccctatctctaaa

SEQ ID NO: 10048709 - DNA, 22 bp, Homo sapiens
cttgtctgataatggggccaac

SEQ ID NO: 10048710 - DNA, 22 bp, Homo sapiens
cttgtctgctataaaaatccag

SEQ ID NO: 10048711 - DNA, 21 bp, Homo sapiens
cttgtctgcagtgtttatagc

SEQ ID NO: 10048712 - DNA, 22 bp, Homo sapiens
cttgtctgggcagcttgggagt

SEQ ID NO: 10048713 - DNA, 22 bp, Homo sapiens
cttgtctgtgtcggataaaact

SEQ ID NO: 10048714 - DNA, 16 bp, Homo sapiens
cttgtctgttgctcat

SEQ ID NO: 10048715 - DNA, 22 bp, Homo sapiens
gagccaagcaccacattaagtt

SEQ ID NO: 10048716 - DNA, 22 bp, Homo sapiens
gagccagagctacaagtgtctg

SEQ ID NO: 10048717 - DNA, 22 bp, Homo sapiens
gagccagcaggacttaagccag

SEQ ID NO: 10048718 - DNA, 21 bp, Homo sapiens
gagatttagaaggatcaattt

SEQ ID NO: 10048719 - DNA, 22 bp, Homo sapiens
gagcagcagctgggccaggttc

SEQ ID NO: 10048720 - DNA, 22 bp, Homo sapiens
gagcagcactgagttagcagct

SEQ ID NO: 10048721 - DNA, 22 bp, Homo sapiens
gagcagagtctatttccacact

SEQ ID NO: 10048722 - DNA, 22 bp, Homo sapiens
gagaggcaggcgctgcaatggt

SEQ ID NO: 10048723 - DNA, 22 bp, Homo sapiens
gagaaggctgatccttggagtt

SEQ ID NO: 10048724 - DNA, 22 bp, Homo sapiens
gaggcactggaggaaaggagaa

SEQ ID NO: 10048725 - DNA, 22 bp, Homo sapiens
gaggagcttgtgagaagatgtc

SEQ ID NO: 10048726 - DNA, 22 bp, Homo sapiens
gagcggcaggagccacctgcct

SEQ ID NO: 10048727 - DNA, 22 bp, Homo sapiens
gagcctggattgaagtgggtgg

SEQ ID NO: 10048728 - DNA, 22 bp, Homo sapiens
gagcctggacatctcaggccca

SEQ ID NO: 10048729 - DNA, 22 bp, Homo sapiens
gagcctgcctctagtctctaga

SEQ ID NO: 10048730 - DNA, 22 bp, Homo sapiens
gagcctgcccagccctgtccac

SEQ ID NO: 10048731 - DNA, 22 bp, Homo sapiens
gagcctgcccagccctgtccac

SEQ ID NO: 10048732 - DNA, 22 bp, Homo sapiens
gagctgaaggagaaagcagggg

SEQ ID NO: 10048733 - DNA, 22 bp, Homo sapiens
gaaatgtactttaaagccatcc

SEQ ID NO: 10048734 - DNA, 22 bp, Homo sapiens
ctttcatccgcagatgagcctc

SEQ ID NO: 10048735 - DNA, 22 bp, Homo sapiens
ctttcataaggggttttataat

SEQ ID NO: 10048736 - DNA, 23 bp, Homo sapiens
ctttcattgtggtttcacagagc

SEQ ID NO: 10048737 - DNA, 22 bp, Homo sapiens
ctttccaactctagtgaaattt

SEQ ID NO: 10048738 - DNA, 22 bp, Homo sapiens
ctttcagaggggcgtacacagc

SEQ ID NO: 10048739 - DNA, 22 bp, Homo sapiens
ctttcacagtcatatgatgaat

SEQ ID NO: 10048740 - DNA, 22 bp, Homo sapiens
ctttcaatgtgcctgccttggg

SEQ ID NO: 10048741 - DNA, 20 bp, Homo sapiens
gaagacacagagttcatctc

SEQ ID NO: 10048742 - DNA, 22 bp, Homo sapiens
gaagacacaattggtgggtcca

SEQ ID NO: 10048743 - DNA, 22 bp, Homo sapiens
gaagacactctgcagagttatc

SEQ ID NO: 10048744 - DNA, 22 bp, Homo sapiens
gaagacactctgcagagttatc

SEQ ID NO: 10048745 - DNA, 22 bp, Homo sapiens
gaagacactaaggcccagggag

SEQ ID NO: 10048746 - DNA, 21 bp, Homo sapiens
gaagacacataacctctctcc

SEQ ID NO: 10048747 - DNA, 22 bp, Homo sapiens
gaagacactaaactggggcttc

SEQ ID NO: 10048748 - DNA, 22 bp, Homo sapiens
gaagacacctactgtcatttct

SEQ ID NO: 10048749 - DNA, 22 bp, Homo sapiens
gaagagaagcatcaataggtaa

SEQ ID NO: 10048750 - DNA, 22 bp, Homo sapiens
gaccctgtttctacaaataatt

SEQ ID NO: 10048751 - DNA, 22 bp, Homo sapiens
gacacagaatttactcccgata

SEQ ID NO: 10048752 - DNA, 22 bp, Homo sapiens
gacacagacagttagaggtaat

SEQ ID NO: 10048753 - DNA, 22 bp, Homo sapiens
gacacagaattcccctccaagt

SEQ ID NO: 10048754 - DNA, 22 bp, Homo sapiens
gacacagaaggtcacatgttca

SEQ ID NO: 10048755 - DNA, 22 bp, Homo sapiens
gaatagataagtgactatttgg

SEQ ID NO: 10048756 - DNA, 22 bp, Homo sapiens
gaatagctgtaggctagtgtct

SEQ ID NO: 10048757 - DNA, 22 bp, Homo sapiens
gaatagcttagattccttagtg

SEQ ID NO: 10048758 - DNA, 22 bp, Homo sapiens
gaatagcttccttttttccaaa

SEQ ID NO: 10048759 - DNA, 22 bp, Homo sapiens
gaatagcttgacaattattttt

SEQ ID NO: 10048760 - DNA, 22 bp, Homo sapiens
gaatacattggaaatcagaata

SEQ ID NO: 10048761 - DNA, 22 bp, Homo sapiens
gaatacatttgccgtggttctc

SEQ ID NO: 10048762 - DNA, 22 bp, Homo sapiens
gaatacatggcagggagtcatc

SEQ ID NO: 10048763 - DNA, 22 bp, Homo sapiens
gaatacatgcacgacacggggg

SEQ ID NO: 10048764 - DNA, 22 bp, Homo sapiens
gaatacatgatacatgaactgc

SEQ ID NO: 10048765 - DNA, 22 bp, Homo sapiens
gaatacatgattaaagtttgat

SEQ ID NO: 10048766 - DNA, 22 bp, Homo sapiens
gaatacatgttgtttccctgga

SEQ ID NO: 10048767 - DNA, 22 bp, Homo sapiens
gaatacatgtgtgtatagaggt

SEQ ID NO: 10048768 - DNA, 22 bp, Homo sapiens
gacaagcaagagtttgctgggc

SEQ ID NO: 10048769 - DNA, 22 bp, Homo sapiens
gacaactgccccattttaaatg

SEQ ID NO: 10048770 - DNA, 22 bp, Homo sapiens
gaagtttagagtgttgtaattt

SEQ ID NO: 10048771 - DNA, 22 bp, Homo sapiens
gaatacatgaaccctcctgtgg

SEQ ID NO: 10048772 - DNA, 22 bp, Homo sapiens
gaatacatatcagatgtgtttc

SEQ ID NO: 10048773 - DNA, 22 bp, Homo sapiens
gaatacatccagagcagggctg

SEQ ID NO: 10048774 - DNA, 22 bp, Homo sapiens
gaatacatctgaaggctatgaa

SEQ ID NO: 10048775 - DNA, 17 bp, Homo sapiens
ctctttataaagagtta

SEQ ID NO: 10048776 - DNA, 21 bp, Homo sapiens
ctctttatatagtaaagatat

SEQ ID NO: 10048777 - DNA, 22 bp, Homo sapiens
ctctttcagttctgatagtctc

SEQ ID NO: 10048778 - DNA, 22 bp, Homo sapiens
ctctttggatgtttatgataag

SEQ ID NO: 10048779 - DNA, 22 bp, Homo sapiens
ctctttggatagaattacaaag

SEQ ID NO: 10048780 - DNA, 22 bp, Homo sapiens
ctgacagctgaattgcttgcat

SEQ ID NO: 10048781 - DNA, 22 bp, Homo sapiens
ctgcactgagaccctctttgct

SEQ ID NO: 10048782 - DNA, 22 bp, Homo sapiens
ctgcactgaagaaaggagctct

SEQ ID NO: 10048783 - DNA, 22 bp, Homo sapiens
ctgcaccatctggagcacctcc

SEQ ID NO: 10048784 - DNA, 22 bp, Homo sapiens
ctgcaccacagcctgaggcagc

SEQ ID NO: 10048785 - DNA, 22 bp, Homo sapiens
ctgcagggcccaaggtcaacgg

SEQ ID NO: 10048786 - DNA, 22 bp, Homo sapiens
ctgcagggcagaagggcataga

SEQ ID NO: 10048787 - DNA, 21 bp, Homo sapiens
ctctgtgttgagggtgttgag

SEQ ID NO: 10048788 - DNA, 22 bp, Homo sapiens
ctcttcagcctatttgagtgca

SEQ ID NO: 10048789 - DNA, 22 bp, Homo sapiens
ctctgcccacgtcttgcccaga

SEQ ID NO: 10048790 - DNA, 22 bp, Homo sapiens
ctctgccctcgcacatctgcca

SEQ ID NO: 10048791 - DNA, 22 bp, Homo sapiens
ctctgcccgcggatgccacgtc

SEQ ID NO: 10048792 - DNA, 22 bp, Homo sapiens
tttgggaaggcagacatcccac

SEQ ID NO: 10048793 - DNA, 22 bp, Homo sapiens
tttgggaagaggaatctctgga

SEQ ID NO: 10048794 - DNA, 22 bp, Homo sapiens
tttgggaactggacttcctgct

SEQ ID NO: 10048795 - DNA, 22 bp, Homo sapiens
tttgggaactggacttcctgct

SEQ ID NO: 10048796 - DNA, 22 bp, Homo sapiens
tttgggaaagtgtcttttgtat

SEQ ID NO: 10048797 - DNA, 21 bp, Homo sapiens
ttgtgaaagtccaggaacaac

SEQ ID NO: 10048798 - DNA, 18 bp, Homo sapiens
ttgtgaaatattggagtc

SEQ ID NO: 10048799 - DNA, 22 bp, Homo sapiens
ttgtgaaacattcatggatttg

SEQ ID NO: 10048800 - DNA, 22 bp, Homo sapiens
ttgtgaaacattcatggatttg

SEQ ID NO: 10048801 - DNA, 22 bp, Homo sapiens
ttgtgaaaagccgcaagtatag

SEQ ID NO: 10048802 - DNA, 22 bp, Homo sapiens
ttgtctgtccaggcaccccaag

SEQ ID NO: 10048803 - DNA, 23 bp, Homo sapiens
ttgtatttttagtagagacaggg

SEQ ID NO: 10048804 - DNA, 22 bp, Homo sapiens
ttgtctttggaaatttaatgtt

SEQ ID NO: 10048805 - DNA, 22 bp, Homo sapiens
ttgtctttcccagcttctagag

SEQ ID NO: 10048806 - DNA, 22 bp, Homo sapiens
ttgtctgtcccagcttgtgcat

SEQ ID NO: 10048807 - DNA, 22 bp, Homo sapiens
ttgtctgtgaaatggaaatagt

SEQ ID NO: 10048808 - DNA, 23 bp, Homo sapiens
ttgtctgtgcttttccagttgct

SEQ ID NO: 10048809 - DNA, 22 bp, Homo sapiens
tttaatagggcccaatgagact

SEQ ID NO: 10048810 - DNA, 22 bp, Homo sapiens
tttaatagggcccaatgagact

SEQ ID NO: 10048811 - DNA, 22 bp, Homo sapiens
tttaatacagaacttgtcaggg

SEQ ID NO: 10048812 - DNA, 22 bp, Homo sapiens
tttaatactatggggatgaaca

SEQ ID NO: 10048813 - DNA, 22 bp, Homo sapiens
ctcccaagctgtgctgaactgt

SEQ ID NO: 10048814 - DNA, 22 bp, Homo sapiens
ttgtaattaatggcagcaatta

SEQ ID NO: 10048815 - DNA, 22 bp, Homo sapiens
ctccaccacacatctgtccacc

SEQ ID NO: 10048816 - DNA, 22 bp, Homo sapiens
ttgtaatttgcaaatgtattgt

SEQ ID NO: 10048817 - DNA, 22 bp, Homo sapiens
ctccagcagaaagggcgagtgg

SEQ ID NO: 10048818 - DNA, 22 bp, Homo sapiens
ttgtacaacgttttaaatttga

SEQ ID NO: 10048819 - DNA, 22 bp, Homo sapiens
ttgaaaggtgaacatgatgcac

SEQ ID NO: 10048820 - DNA, 22 bp, Homo sapiens
ctcatttatccaaaagccagtt

SEQ ID NO: 10048821 - DNA, 21 bp, Homo sapiens
ctcatttatttttgtgtccaa

SEQ ID NO: 10048822 - DNA, 22 bp, Homo sapiens
ctcatttacactatgggaacta

SEQ ID NO: 10048823 - DNA, 22 bp, Homo sapiens
ctcatttacctttgcaatcaag

SEQ ID NO: 10048824 - DNA, 22 bp, Homo sapiens
ctcatttaacagattaaaaagt

SEQ ID NO: 10048825 - DNA, 22 bp, Homo sapiens
ctcatttactactcatgtgacc

SEQ ID NO: 10048826 - DNA, 22 bp, Homo sapiens
ctcatttactgtagaacagtta

SEQ ID NO: 10048827 - DNA, 22 bp, Homo sapiens
tttagtagaatagtatatcaaa

SEQ ID NO: 10048828 - DNA, 22 bp, Homo sapiens
tttagtatataaaaagagaagt

SEQ ID NO: 10048829 - DNA, 22 bp, Homo sapiens
tttagtatgtatttaatggact

SEQ ID NO: 10048830 - DNA, 22 bp, Homo sapiens
ctcctccagcttccagtggctc

SEQ ID NO: 10048831 - DNA, 22 bp, Homo sapiens
ctcctccagtgggtccctcagg

SEQ ID NO: 10048832 - DNA, 22 bp, Homo sapiens
ctcctccagtgggtccctcagg

SEQ ID NO: 10048833 - DNA, 22 bp, Homo sapiens
tttcaaatggatccctcagcct

SEQ ID NO: 10048834 - DNA, 22 bp, Homo sapiens
tttcacaaactgaggagacaat

SEQ ID NO: 10048835 - DNA, 22 bp, Homo sapiens
ttaggatttgaaaaggggcaga

SEQ ID NO: 10048836 - DNA, 22 bp, Homo sapiens
cgcatccagggcgcaggatctg

SEQ ID NO: 10048837 - DNA, 21 bp, Homo sapiens
ttcaatactatttcaatagtc

SEQ ID NO: 10048838 - DNA, 22 bp, Homo sapiens
ttcaatacaaagaaaggaattt

SEQ ID NO: 10048839 - DNA, 22 bp, Homo sapiens
ttcaataggatgcatgatataa

SEQ ID NO: 10048840 - DNA, 22 bp, Homo sapiens
ttcacacagaatctgaggagct

SEQ ID NO: 10048841 - DNA, 22 bp, Homo sapiens
ttcaagttacctttaaacagct

SEQ ID NO: 10048842 - DNA, 22 bp, Homo sapiens
ttcagatgtggctttgtcaggc

SEQ ID NO: 10048843 - DNA, 22 bp, Homo sapiens
ttcagatatcattaatttagta

SEQ ID NO: 10048844 - DNA, 22 bp, Homo sapiens
ttcagataaactacaaataatt

SEQ ID NO: 10048845 - DNA, 22 bp, Homo sapiens
ttcacagaattgtcttgactgg

SEQ ID NO: 10048846 - DNA, 22 bp, Homo sapiens
ctaaagcaactgagacacatag

SEQ ID NO: 10048847 - DNA, 22 bp, Homo sapiens
ctaaagaagctagcaatctata

SEQ ID NO: 10048848 - DNA, 22 bp, Homo sapiens
ctaaacttttataacattgaga

SEQ ID NO: 10048849 - DNA, 22 bp, Homo sapiens
cggtctcccgtgtgtgtgcgct

SEQ ID NO: 10048850 - DNA, 19 bp, Homo sapiens
cggtggcttgcagggaggt

SEQ ID NO: 10048851 - DNA, 22 bp, Homo sapiens
ctcaaaatccataaaatcaggt

SEQ ID NO: 10048852 - DNA, 22 bp, Homo sapiens
ctattatttcctcatctataaa

SEQ ID NO: 10048853 - DNA, 22 bp, Homo sapiens
ctcaagatcatcaatataccaa

SEQ ID NO: 10048854 - DNA, 22 bp, Homo sapiens
ctcacagagctcatactgggag

SEQ ID NO: 10048855 - DNA, 22 bp, Homo sapiens
ctcacaggagaaagtcatggtc

SEQ ID NO: 10048856 - DNA, 22 bp, Homo sapiens
ctcacaggagaaagtcatggtc

SEQ ID NO: 10048857 - DNA, 22 bp, Homo sapiens
ctcacaggtcatgtggtggctt

SEQ ID NO: 10048858 - DNA, 22 bp, Homo sapiens
ctcacaggttagttgtgtggat

SEQ ID NO: 10048859 - DNA, 22 bp, Homo sapiens
ctcacaggtaccagcaccctcc

SEQ ID NO: 10048860 - DNA, 22 bp, Homo sapiens
ctatggtgatagaaatcagaat

SEQ ID NO: 10048861 - DNA, 22 bp, Homo sapiens
ctattacatttctggacattca

SEQ ID NO: 10048862 - DNA, 22 bp, Homo sapiens
ctagcagcattcttctagttag

SEQ ID NO: 10048863 - DNA, 22 bp, Homo sapiens
ctagcagctctgatatttacaa

SEQ ID NO: 10048864 - DNA, 22 bp, Homo sapiens
ctagcagcattcttctagttag

SEQ ID NO: 10048865 - DNA, 22 bp, Homo sapiens
ctagcagcatcacaggaagact

SEQ ID NO: 10048866 - DNA, 22 bp, Homo sapiens
ctagcagctctgatatttacaa

SEQ ID NO: 10048867 - DNA, 22 bp, Homo sapiens
ttccaggactcgttctggctca

SEQ ID NO: 10048868 - DNA, 22 bp, Homo sapiens
ttccaggacaagatgtttcagg

SEQ ID NO: 10048869 - DNA, 22 bp, Homo sapiens
ctaaatgacttccagtggttat

SEQ ID NO: 10048870 - DNA, 22 bp, Homo sapiens
ctacttctgtgatgaaactaca

SEQ ID NO: 10048871 - DNA, 22 bp, Homo sapiens
ctagaaaaatactttattgtga

SEQ ID NO: 10048872 - DNA, 22 bp, Homo sapiens
ctactgtagtggcctatttacc

SEQ ID NO: 10048873 - DNA, 22 bp, Homo sapiens
ctacatttcatccagggagagc

SEQ ID NO: 10048874 - DNA, 22 bp, Homo sapiens
tgtgttctcctacagataagga

SEQ ID NO: 10048875 - DNA, 22 bp, Homo sapiens
tgtgtctgcccttagtacatct

SEQ ID NO: 10048876 - DNA, 22 bp, Homo sapiens
tgttcatttggcccttttgtat

SEQ ID NO: 10048877 - DNA, 22 bp, Homo sapiens
tgttcattttgaagtacttcaa

SEQ ID NO: 10048878 - DNA, 22 bp, Homo sapiens
tgttcattctgtgacctggttc

SEQ ID NO: 10048879 - DNA, 22 bp, Homo sapiens
tgttcattgccccctgtgtaaa

SEQ ID NO: 10048880 - DNA, 22 bp, Homo sapiens
tgttcattagtggaagtaagtt

SEQ ID NO: 10048881 - DNA, 22 bp, Homo sapiens
tgttcattccggggagggctaa

SEQ ID NO: 10048882 - DNA, 23 bp, Homo sapiens
tgttccagatacgccttttcctc

SEQ ID NO: 10048883 - DNA, 22 bp, Homo sapiens
tgttcattaaactactgtgtgg

SEQ ID NO: 10048884 - DNA, 22 bp, Homo sapiens
tgttcagtttgctatcataatc

SEQ ID NO: 10048885 - DNA, 22 bp, Homo sapiens
tgttcagccctctattaatcag

SEQ ID NO: 10048886 - DNA, 22 bp, Homo sapiens
tgttcagttaacacagacacca

SEQ ID NO: 10048887 - DNA, 22 bp, Homo sapiens
tgttacagaaagtttatgaatg

SEQ ID NO: 10048888 - DNA, 22 bp, Homo sapiens
tgttacagtactacaattctgc

SEQ ID NO: 10048889 - DNA, 22 bp, Homo sapiens
tgttacagcagaattgaaagag

SEQ ID NO: 10048890 - DNA, 21 bp, Homo sapiens
cctggttggcgtagctcagtc

SEQ ID NO: 10048891 - DNA, 22 bp, Homo sapiens
cctggtggacagcagccagcag

SEQ ID NO: 10048892 - DNA, 22 bp, Homo sapiens
tggggctgtgagactacaggat

SEQ ID NO: 10048893 - DNA, 22 bp, Homo sapiens
tggggctgtccttagtctgaga

SEQ ID NO: 10048894 - DNA, 22 bp, Homo sapiens
tggggcagggatgggaaactat

SEQ ID NO: 10048895 - DNA, 22 bp, Homo sapiens
tgtgtatagatgcatgcatata

SEQ ID NO: 10048896 - DNA, 22 bp, Homo sapiens
tgtgtatattaggacacattct

SEQ ID NO: 10048897 - DNA, 22 bp, Homo sapiens
tgtgtattaatgtttgtatatg

SEQ ID NO: 10048898 - DNA, 22 bp, Homo sapiens
ttagacaatctgttggtaaggt

SEQ ID NO: 10048899 - DNA, 23 bp, Homo sapiens
ttagacaatcctcaaaaggtaat

SEQ ID NO: 10048900 - DNA, 22 bp, Homo sapiens
ttagaaaaaggctgtggtctta

SEQ ID NO: 10048901 - DNA, 22 bp, Homo sapiens
ttagaaaacataagtggtaaag

SEQ ID NO: 10048902 - DNA, 22 bp, Homo sapiens
ttagaaaaatgttcagtagttt

SEQ ID NO: 10048903 - DNA, 22 bp, Homo sapiens
ttagaaaatggaggtgggaggg

SEQ ID NO: 10048904 - DNA, 22 bp, Homo sapiens
ttagaaaaaacgtcttctagtg

SEQ ID NO: 10048905 - DNA, 22 bp, Homo sapiens
ttagaaaaaacgtcttctagtg

SEQ ID NO: 10048906 - DNA, 22 bp, Homo sapiens
ccttcccatgcagcctgtctga

SEQ ID NO: 10048907 - DNA, 18 bp, Homo sapiens
ccttcagctctggttttc

SEQ ID NO: 10048908 - DNA, 22 bp, Homo sapiens
ccttccagtgactaaggaggaa

SEQ ID NO: 10048909 - DNA, 22 bp, Homo sapiens
cctgtgtcttccccactggtgt

SEQ ID NO: 10048910 - DNA, 22 bp, Homo sapiens
cctgtgtggccgcactgctccc

SEQ ID NO: 10048911 - DNA, 22 bp, Homo sapiens
cctgtgtggccaggctggagtc

SEQ ID NO: 10048912 - DNA, 20 bp, Homo sapiens
cctgtgtggccagctgaggc

SEQ ID NO: 10048913 - DNA, 20 bp, Homo sapiens
cctgtgtggtttgcactaca

SEQ ID NO: 10048914 - DNA, 22 bp, Homo sapiens
cctgtgtgtaggccaggggagt

SEQ ID NO: 10048915 - DNA, 22 bp, Homo sapiens
ttaaatagctcttgtagaagaa

SEQ ID NO: 10048916 - DNA, 22 bp, Homo sapiens
ttaaagtccctgccttaattcc

SEQ ID NO: 10048917 - DNA, 22 bp, Homo sapiens
cctgtgtcagcccctgcctcca

SEQ ID NO: 10048918 - DNA, 22 bp, Homo sapiens
cctgtggttacgcctgtttcca

SEQ ID NO: 10048919 - DNA, 22 bp, Homo sapiens
cctgtggtttacgtacagctcc

SEQ ID NO: 10048920 - DNA, 22 bp, Homo sapiens
ttaaagctggcgttacagtttg

SEQ ID NO: 10048921 - DNA, 22 bp, Homo sapiens
ttaaaggaattgagtttcttgt

SEQ ID NO: 10048922 - DNA, 23 bp, Homo sapiens
ttaaaggcagatgttgagtatta

SEQ ID NO: 10048923 - DNA, 22 bp, Homo sapiens
tgtttataaattttcttgccat

SEQ ID NO: 10048924 - DNA, 22 bp, Homo sapiens
cctcttccttctcactgtggaa

SEQ ID NO: 10048925 - DNA, 22 bp, Homo sapiens
cctgagctcaagaaggtgacca

SEQ ID NO: 10048926 - DNA, 22 bp, Homo sapiens
cctctgctgctgttgagcaccg

SEQ ID NO: 10048927 - DNA, 22 bp, Homo sapiens
tgggaaggacgtgtcagtggca

SEQ ID NO: 10048928 - DNA, 22 bp, Homo sapiens
tggctgggagctggaactgggc

SEQ ID NO: 10048929 - DNA, 22 bp, Homo sapiens
cctcagagttatttgaagtgaa

SEQ ID NO: 10048930 - DNA, 22 bp, Homo sapiens
tggctctggtgcgggctcctgc

SEQ ID NO: 10048931 - DNA, 18 bp, Homo sapiens
cctccaagtccccagcct

SEQ ID NO: 10048932 - DNA, 22 bp, Homo sapiens
cctagccttcggcctacccatc

SEQ ID NO: 10048933 - DNA, 22 bp, Homo sapiens
cctagagctctgctttatctaa

SEQ ID NO: 10048934 - DNA, 22 bp, Homo sapiens
cccttcctcaaggagctgtgtt

SEQ ID NO: 10048935 - DNA, 22 bp, Homo sapiens
cccttcctcaaggagctgtgtt

SEQ ID NO: 10048936 - DNA, 22 bp, Homo sapiens
cccttcctcctcgcctgtcaga

SEQ ID NO: 10048937 - DNA, 22 bp, Homo sapiens
tggagcagggcatcactgtgcg

SEQ ID NO: 10048938 - DNA, 19 bp, Homo sapiens
tggagcagggcccttgttt

SEQ ID NO: 10048939 - DNA, 22 bp, Homo sapiens
tggagcaggccggaagtggctt

SEQ ID NO: 10048940 - DNA, 22 bp, Homo sapiens
tggagcagggcatcactgtgcg

SEQ ID NO: 10048941 - DNA, 22 bp, Homo sapiens
cccaggtcccgccccagctcta

SEQ ID NO: 10048942 - DNA, 22 bp, Homo sapiens
cccatttgtatagagccttata

SEQ ID NO: 10048943 - DNA, 22 bp, Homo sapiens
cccatttgtccaaagtataaaa

SEQ ID NO: 10048944 - DNA, 22 bp, Homo sapiens
cccattttgcttatgctgctgt

SEQ ID NO: 10048945 - DNA, 22 bp, Homo sapiens
ccccaccctcgctccatttcgg

SEQ ID NO: 10048946 - DNA, 22 bp, Homo sapiens
ccccaccctcgctccatttcgg

SEQ ID NO: 10048947 - DNA, 22 bp, Homo sapiens
ccccacccacctaagagaaact

SEQ ID NO: 10048948 - DNA, 22 bp, Homo sapiens
ccccacagccgccagcagggag

SEQ ID NO: 10048949 - DNA, 20 bp, Homo sapiens
ccccacactattgagcactt

SEQ ID NO: 10048950 - DNA, 22 bp, Homo sapiens
ccccacaactcatgttgaaact

SEQ ID NO: 10048951 - DNA, 22 bp, Homo sapiens
ccccacagtccgtgaggagcca

SEQ ID NO: 10048952 - DNA, 22 bp, Homo sapiens
tgctggctttagtgattggggt

SEQ ID NO: 10048953 - DNA, 22 bp, Homo sapiens
tgctggctttaaggttaaagtg

SEQ ID NO: 10048954 - DNA, 22 bp, Homo sapiens
tgctggctaatggaaaccagat

SEQ ID NO: 10048955 - DNA, 22 bp, Homo sapiens
tgctggctacattattgctgtc

SEQ ID NO: 10048956 - DNA, 23 bp, Homo sapiens
tgctggctaagaatctgcatttt

SEQ ID NO: 10048957 - DNA, 23 bp, Homo sapiens
tgctggcttttatctggtcccta

SEQ ID NO: 10048958 - DNA, 22 bp, Homo sapiens
tgctggcttttccttcaggcag

SEQ ID NO: 10048959 - DNA, 22 bp, Homo sapiens
tgctggctttctgtccctggca

SEQ ID NO: 10048960 - DNA, 22 bp, Homo sapiens
tgctggctttgcgagatgcatt

SEQ ID NO: 10048961 - DNA, 22 bp, Homo sapiens
tgctggctttttgtgtcaaaga

SEQ ID NO: 10048962 - DNA, 22 bp, Homo sapiens
tgctggctttttggtccttgct

SEQ ID NO: 10048963 - DNA, 22 bp, Homo sapiens
tgctggctttttggtccttgct

SEQ ID NO: 10048964 - DNA, 22 bp, Homo sapiens
ccctcctgtgcctgaggccagc

SEQ ID NO: 10048965 - DNA, 22 bp, Homo sapiens
ccctcctggaggcggatgccca

SEQ ID NO: 10048966 - DNA, 22 bp, Homo sapiens
tgctgtgtggatgtgaagaatc

SEQ ID NO: 10048967 - DNA, 22 bp, Homo sapiens
tgctgtgttcctcagtttcatg

SEQ ID NO: 10048968 - DNA, 22 bp, Homo sapiens
ccctgacttgatctttgacttg

SEQ ID NO: 10048969 - DNA, 22 bp, Homo sapiens
ccctgaccctatcagagggcca

SEQ ID NO: 10048970 - DNA, 22 bp, Homo sapiens
tggagcaggactgctgccctca

SEQ ID NO: 10048971 - DNA, 22 bp, Homo sapiens
cccaggagacatatagaaggac

SEQ ID NO: 10048972 - DNA, 22 bp, Homo sapiens
tgccaggaggaggtgggacaga

SEQ ID NO: 10048973 - DNA, 22 bp, Homo sapiens
tgccctggggtctggagcagca

SEQ ID NO: 10048974 - DNA, 22 bp, Homo sapiens
tgccagttgggaaaacagacat

SEQ ID NO: 10048975 - DNA, 22 bp, Homo sapiens
tgcccagctgtcaaagtagata

SEQ ID NO: 10048976 - DNA, 22 bp, Homo sapiens
cccaggctggagtgcaatggca

SEQ ID NO: 10048977 - DNA, 22 bp, Homo sapiens
cccaggctggagtgcagtggcg

SEQ ID NO: 10048978 - DNA, 22 bp, Homo sapiens
cccaggctggagtgcaatggtg

SEQ ID NO: 10048979 - DNA, 22 bp, Homo sapiens
cccagggaatgactctggcctt

SEQ ID NO: 10048980 - DNA, 22 bp, Homo sapiens
cccaggctggggctcctccagc

SEQ ID NO: 10048981 - DNA, 22 bp, Homo sapiens
cccaggctggcctccgcagtgc

SEQ ID NO: 10048982 - DNA, 22 bp, Homo sapiens
tgccttcctgctttgagttctg

SEQ ID NO: 10048983 - DNA, 22 bp, Homo sapiens
tgcctgttgcccacctgataaa

SEQ ID NO: 10048984 - DNA, 22 bp, Homo sapiens
cccagggacagatgggcagcta

SEQ ID NO: 10048985 - DNA, 22 bp, Homo sapiens
cccagggattataaaggtgaaa

SEQ ID NO: 10048986 - DNA, 22 bp, Homo sapiens
cccagggttgcctgcctctgct

SEQ ID NO: 10048987 - DNA, 22 bp, Homo sapiens
tgaatgatgcagtataatgata

SEQ ID NO: 10048988 - DNA, 20 bp, Homo sapiens
tgacaacaaaatggtaattt

SEQ ID NO: 10048989 - DNA, 23 bp, Homo sapiens
tgacaacagctctcagccatgtc

SEQ ID NO: 10048990 - DNA, 22 bp, Homo sapiens
ccaggctggagtgcagtggcac

SEQ ID NO: 10048991 - DNA, 22 bp, Homo sapiens
tgagaaaaggttgagatgataa

SEQ ID NO: 10048992 - DNA, 22 bp, Homo sapiens
tgacatcagaatggcatagaaa

SEQ ID NO: 10048993 - DNA, 22 bp, Homo sapiens
tgagacagttctgcagctgggt

SEQ ID NO: 10048994 - DNA, 17 bp, Homo sapiens
ccaggtctccttgcttt

SEQ ID NO: 10048995 - DNA, 22 bp, Homo sapiens
ccaggggttggaggttgcagtg

SEQ ID NO: 10048996 - DNA, 22 bp, Homo sapiens
ccatgcgcacccaggggaagct

SEQ ID NO: 10048997 - DNA, 22 bp, Homo sapiens
ccatgctccttaccactcactt

SEQ ID NO: 10048998 - DNA, 22 bp, Homo sapiens
ccagtcctgctccctgaccacc

SEQ ID NO: 10048999 - DNA, 22 bp, Homo sapiens
ccagtcctttgagccagttctg

SEQ ID NO: 10049000 - DNA, 22 bp, Homo sapiens
tgagggctaaattgtggcaggt

SEQ ID NO: 10049001 - DNA, 22 bp, Homo sapiens
tgagggcacctgggattaatgg

SEQ ID NO: 10049002 - DNA, 22 bp, Homo sapiens
tgcacacatgtttacaagcatc

SEQ ID NO: 10049003 - DNA, 22 bp, Homo sapiens
tgcacacatgtatgtatatgtg

SEQ ID NO: 10049004 - DNA, 22 bp, Homo sapiens
tgcacacattaaggatacacag

SEQ ID NO: 10049005 - DNA, 22 bp, Homo sapiens
cccactgtttccctgaggctct

SEQ ID NO: 10049006 - DNA, 22 bp, Homo sapiens
tgcaaatacaaaatggtacagc

SEQ ID NO: 10049007 - DNA, 19 bp, Homo sapiens
ccattgtaaagaaaaatgt

SEQ ID NO: 10049008 - DNA, 22 bp, Homo sapiens
tctgggagcagatgatggtata

SEQ ID NO: 10049009 - DNA, 22 bp, Homo sapiens
ccaggacttattacagtataac

SEQ ID NO: 10049010 - DNA, 22 bp, Homo sapiens
tctggtgtcaggctgtcctcgg

SEQ ID NO: 10049011 - DNA, 22 bp, Homo sapiens
ccaggacaggagttggcttcgc

SEQ ID NO: 10049012 - DNA, 22 bp, Homo sapiens
ccaggacacgatttttagtctg

SEQ ID NO: 10049013 - DNA, 22 bp, Homo sapiens
ccagctctcagcgggagactca

SEQ ID NO: 10049014 - DNA, 22 bp, Homo sapiens
tctgctttagacataaaaggta

SEQ ID NO: 10049015 - DNA, 22 bp, Homo sapiens
tctgctttcaaattcacttagt

SEQ ID NO: 10049016 - DNA, 22 bp, Homo sapiens
tctgctttcttactaaaaatga

SEQ ID NO: 10049017 - DNA, 22 bp, Homo sapiens
ccagagagaaaatggagggcca

SEQ ID NO: 10049018 - DNA, 22 bp, Homo sapiens
tctggaggccatagggaaggat

SEQ ID NO: 10049019 - DNA, 22 bp, Homo sapiens
ccagctctctgtcctccccaca

SEQ ID NO: 10049020 - DNA, 22 bp, Homo sapiens
ccagctctgcagggcctggggt

SEQ ID NO: 10049021 - DNA, 22 bp, Homo sapiens
ccagctctgcagggcctggggt

SEQ ID NO: 10049022 - DNA, 22 bp, Homo sapiens
ccagctctgattttgacctcca

SEQ ID NO: 10049023 - DNA, 22 bp, Homo sapiens
ccagctctgattttgacctcca

SEQ ID NO: 10049024 - DNA, 22 bp, Homo sapiens
tctttcttggtataaagcaggg

SEQ ID NO: 10049025 - DNA, 22 bp, Homo sapiens
ccaggctctgttccccgaggag

SEQ ID NO: 10049026 - DNA, 22 bp, Homo sapiens
tctttggtattcacttgtgaag

SEQ ID NO: 10049027 - DNA, 23 bp, Homo sapiens
tctttggtaaataaagtggggat

SEQ ID NO: 10049028 - DNA, 22 bp, Homo sapiens
tctttggtcatcatgggaagca

SEQ ID NO: 10049029 - DNA, 22 bp, Homo sapiens
tctttggtcagaaagattacac

SEQ ID NO: 10049030 - DNA, 22 bp, Homo sapiens
tctttggtgatatctctttggt

SEQ ID NO: 10049031 - DNA, 22 bp, Homo sapiens
tctttggtgatatctctttggt

SEQ ID NO: 10049032 - DNA, 22 bp, Homo sapiens
tctttggtgaatggtcatccag

SEQ ID NO: 10049033 - DNA, 22 bp, Homo sapiens
ccaggccagcctggagcatggc

SEQ ID NO: 10049034 - DNA, 22 bp, Homo sapiens
ccaggccagcgctggctggagg

SEQ ID NO: 10049035 - DNA, 22 bp, Homo sapiens
tcttcagataaagggagagtat

SEQ ID NO: 10049036 - DNA, 22 bp, Homo sapiens
tcttcagagtgaaagtctgtga

SEQ ID NO: 10049037 - DNA, 22 bp, Homo sapiens
tcttcagacccttagctgtgat

SEQ ID NO: 10049038 - DNA, 22 bp, Homo sapiens
tcagtccataggtgggcctgag

SEQ ID NO: 10049039 - DNA, 22 bp, Homo sapiens
tcagtccaggggctgtgatgtc

SEQ ID NO: 10049040 - DNA, 22 bp, Homo sapiens
catctgcaggggaagccagttt

SEQ ID NO: 10049041 - DNA, 21 bp, Homo sapiens
catctcagtgggttggtggat

SEQ ID NO: 10049042 - DNA, 19 bp, Homo sapiens
catctgtaaggacagaaac

SEQ ID NO: 10049043 - DNA, 22 bp, Homo sapiens
catctgtagctccatgacaatt

SEQ ID NO: 10049044 - DNA, 22 bp, Homo sapiens
catgaacaccaggcatgaacaa

SEQ ID NO: 10049045 - DNA, 22 bp, Homo sapiens
catgaaaataacattgttgtga

SEQ ID NO: 10049046 - DNA, 22 bp, Homo sapiens
tccaggagaaggccatccagcg

SEQ ID NO: 10049047 - DNA, 22 bp, Homo sapiens
catggcagggctgtgggcaggt

SEQ ID NO: 10049048 - DNA, 22 bp, Homo sapiens
catggcaggaaggacatgcact

SEQ ID NO: 10049049 - DNA, 22 bp, Homo sapiens
catggcaggatctgggcccaca

SEQ ID NO: 10049050 - DNA, 22 bp, Homo sapiens
catggcagagaaggggaactgg

SEQ ID NO: 10049051 - DNA, 23 bp, Homo sapiens
catggcagcaagagctcatggcc

SEQ ID NO: 10049052 - DNA, 22 bp, Homo sapiens
catgcacacacgtgcatgtacg

SEQ ID NO: 10049053 - DNA, 22 bp, Homo sapiens
catgagaaggggtggagttaga

SEQ ID NO: 10049054 - DNA, 22 bp, Homo sapiens
tcagagagttttcactagggtg

SEQ ID NO: 10049055 - DNA, 22 bp, Homo sapiens
tcagagagttagtgtcttagct

SEQ ID NO: 10049056 - DNA, 22 bp, Homo sapiens
tcagagcaaattcctgtgagcc

SEQ ID NO: 10049057 - DNA, 22 bp, Homo sapiens
tcagagatgcagtgccacctac

SEQ ID NO: 10049058 - DNA, 22 bp, Homo sapiens
cagttcttatttggccagtgtc

SEQ ID NO: 10049059 - DNA, 22 bp, Homo sapiens
cagttataagactaagctattc

SEQ ID NO: 10049060 - DNA, 23 bp, Homo sapiens
tcagagcaagatgatgtatgagc

SEQ ID NO: 10049061 - DNA, 22 bp, Homo sapiens
tcagatatggagtctaaaacca

SEQ ID NO: 10049062 - DNA, 22 bp, Homo sapiens
cagtttttgccattaagagtaa

SEQ ID NO: 10049063 - DNA, 22 bp, Homo sapiens
cagtttttcaaaattacatgat

SEQ ID NO: 10049064 - DNA, 23 bp, Homo sapiens
cataaaatattagtatggtagca

SEQ ID NO: 10049065 - DNA, 23 bp, Homo sapiens
cataaaatattagtatggtagca

SEQ ID NO: 10049066 - DNA, 22 bp, Homo sapiens
catagaaacttgcagcaagcac

SEQ ID NO: 10049067 - DNA, 22 bp, Homo sapiens
cataatgtctgacacagtaaga

SEQ ID NO: 10049068 - DNA, 22 bp, Homo sapiens
cataatatctccgattacttgc

SEQ ID NO: 10049069 - DNA, 22 bp, Homo sapiens
tccatttagctggcaaacaatg

SEQ ID NO: 10049070 - DNA, 22 bp, Homo sapiens
catgggcagttggcagggctca

SEQ ID NO: 10049071 - DNA, 21 bp, Homo sapiens
tccaggagcacgggactagga

SEQ ID NO: 10049072 - DNA, 22 bp, Homo sapiens
tccaggagaggcctgaccaggt

SEQ ID NO: 10049073 - DNA, 22 bp, Homo sapiens
cattacatttcaaaatgtttcc

SEQ ID NO: 10049074 - DNA, 22 bp, Homo sapiens
cattacatctttgatgcagtat

SEQ ID NO: 10049075 - DNA, 22 bp, Homo sapiens
cattacagaatatgtaatgatc

SEQ ID NO: 10049076 - DNA, 22 bp, Homo sapiens
tcccacatgtgaatcctcaggt

SEQ ID NO: 10049077 - DNA, 22 bp, Homo sapiens
tcccacccatcctgcatctctt

SEQ ID NO: 10049078 - DNA, 22 bp, Homo sapiens
tcccaccccctccaaggaggaa

SEQ ID NO: 10049079 - DNA, 22 bp, Homo sapiens
tcccaccccctccaaggaggaa

SEQ ID NO: 10049080 - DNA, 22 bp, Homo sapiens
tcccaccccggtcaagggctga

SEQ ID NO: 10049081 - DNA, 22 bp, Homo sapiens
cattcttatatttactcattca

SEQ ID NO: 10049082 - DNA, 22 bp, Homo sapiens
cattctgcatttggaaggggca

SEQ ID NO: 10049083 - DNA, 22 bp, Homo sapiens
cattctgcgatcctcaagcaca

SEQ ID NO: 10049084 - DNA, 22 bp, Homo sapiens
catttattgagtggccacagtg

SEQ ID NO: 10049085 - DNA, 22 bp, Homo sapiens
tccctctccctattgcctggag

SEQ ID NO: 10049086 - DNA, 22 bp, Homo sapiens
catttaatccatagaggaatgt

SEQ ID NO: 10049087 - DNA, 22 bp, Homo sapiens
cattgtacagttattttaaaat

SEQ ID NO: 10049088 - DNA, 22 bp, Homo sapiens
tcctgggagagtgggactgtat

SEQ ID NO: 10049089 - DNA, 22 bp, Homo sapiens
tcctagaaagatgtcttttcac

SEQ ID NO: 10049090 - DNA, 19 bp, Homo sapiens
tcctggggaggggcatggc

SEQ ID NO: 10049091 - DNA, 19 bp, Homo sapiens
tccttaaaaaagcagttct

SEQ ID NO: 10049092 - DNA, 22 bp, Homo sapiens
tccttccaggtccagggatgtg

SEQ ID NO: 10049093 - DNA, 22 bp, Homo sapiens
tccttccatggtggggctgctt

SEQ ID NO: 10049094 - DNA, 21 bp, Homo sapiens
tccttcagttctgcactttct

SEQ ID NO: 10049095 - DNA, 22 bp, Homo sapiens
tccttcagttcaattagtccgt

SEQ ID NO: 10049096 - DNA, 22 bp, Homo sapiens
tccttcagttatcacagtactg

SEQ ID NO: 10049097 - DNA, 22 bp, Homo sapiens
tccttcagttaaagatctcaca

SEQ ID NO: 10049098 - DNA, 21 bp, Homo sapiens
tccttcagtctagatgattgt

SEQ ID NO: 10049099 - DNA, 22 bp, Homo sapiens
tccttcagtcttctgagccata

SEQ ID NO: 10049100 - DNA, 22 bp, Homo sapiens
tccttcagtgtcccgctcaggt

SEQ ID NO: 10049101 - DNA, 17 bp, Homo sapiens
tccttcagtgcctctgc

SEQ ID NO: 10049102 - DNA, 22 bp, Homo sapiens
tcctttaaactcctttcaagtc

SEQ ID NO: 10049103 - DNA, 22 bp, Homo sapiens
ccactgggggctgctcccaggt

SEQ ID NO: 10049104 - DNA, 22 bp, Homo sapiens
ccactgtcagaggggctgtgcc

SEQ ID NO: 10049105 - DNA, 22 bp, Homo sapiens
ccactgtcttttccaggctgaa

SEQ ID NO: 10049106 - DNA, 22 bp, Homo sapiens
tctaagtaaaatttgtcatttc

SEQ ID NO: 10049107 - DNA, 22 bp, Homo sapiens
ccagacaggggctgttcctgct

SEQ ID NO: 10049108 - DNA, 22 bp, Homo sapiens
cagtcacagtgacaggatgtgg

SEQ ID NO: 10049109 - DNA, 22 bp, Homo sapiens
caggtgggtgtatgaatgcaaa

SEQ ID NO: 10049110 - DNA, 22 bp, Homo sapiens
tcaaaacactattacctttaat

SEQ ID NO: 10049111 - DNA, 19 bp, Homo sapiens
tcaaaacacaaatggttga

SEQ ID NO: 10049112 - DNA, 22 bp, Homo sapiens
tcaaaacactattacctttaat

SEQ ID NO: 10049113 - DNA, 22 bp, Homo sapiens
tattaaatgttatttgggttgt

SEQ ID NO: 10049114 - DNA, 19 bp, Homo sapiens
caggtggcgctctacaggg

SEQ ID NO: 10049115 - DNA, 23 bp, Homo sapiens
caggtggctccacgaggggtggg

SEQ ID NO: 10049116 - DNA, 22 bp, Homo sapiens
caggtggccttgccatctcctg

SEQ ID NO: 10049117 - DNA, 22 bp, Homo sapiens
caggtggcattgtcccgccagc

SEQ ID NO: 10049118 - DNA, 22 bp, Homo sapiens
caggtggcatgactgcctacaa

SEQ ID NO: 10049119 - DNA, 22 bp, Homo sapiens
caggtggcagtgcctgcattct

SEQ ID NO: 10049120 - DNA, 22 bp, Homo sapiens
caggtgggtacatcacagagac

SEQ ID NO: 10049121 - DNA, 18 bp, Homo sapiens
caggtgggtctcctgccc

SEQ ID NO: 10049122 - DNA, 18 bp, Homo sapiens
caggtgggtctcctgccc

SEQ ID NO: 10049123 - DNA, 22 bp, Homo sapiens
tattatcattaactgttgaatt

SEQ ID NO: 10049124 - DNA, 22 bp, Homo sapiens
caggtcagaggcgcagccccca

SEQ ID NO: 10049125 - DNA, 22 bp, Homo sapiens
taggaggcttaaagctgctcag

SEQ ID NO: 10049126 - DNA, 22 bp, Homo sapiens
tagctttaaaaatcatcaaagc

SEQ ID NO: 10049127 - DNA, 22 bp, Homo sapiens
tagcttctggagtgtttgaaaa

SEQ ID NO: 10049128 - DNA, 22 bp, Homo sapiens
tagcttctaatacttaccaatt

SEQ ID NO: 10049129 - DNA, 22 bp, Homo sapiens
tagcttatcccacagtgcccag

SEQ ID NO: 10049130 - DNA, 22 bp, Homo sapiens
cagggtagggcaagggaacctg

SEQ ID NO: 10049131 - DNA, 22 bp, Homo sapiens
cagggggtggtccaggctgcgc

SEQ ID NO: 10049132 - DNA, 22 bp, Homo sapiens
cagggggctcaaaggagagtgc

SEQ ID NO: 10049133 - DNA, 22 bp, Homo sapiens
cagggggctcaaaggagagtgc

SEQ ID NO: 10049134 - DNA, 22 bp, Homo sapiens
cagggggcagcgtagaaaatga

SEQ ID NO: 10049135 - DNA, 22 bp, Homo sapiens
cagggggctgtggctgtccagt

SEQ ID NO: 10049136 - DNA, 22 bp, Homo sapiens
cagggggctcaaaggagagtgc

SEQ ID NO: 10049137 - DNA, 22 bp, Homo sapiens
taggctgggctgagctggacgg

SEQ ID NO: 10049138 - DNA, 22 bp, Homo sapiens
taggctgggcctgccttccagg

SEQ ID NO: 10049139 - DNA, 22 bp, Homo sapiens
taagtcatcacattgcagagat

SEQ ID NO: 10049140 - DNA, 22 bp, Homo sapiens
taagtcataagtcatgatgtta

SEQ ID NO: 10049141 - DNA, 18 bp, Homo sapiens
taagtcattttgccagca

SEQ ID NO: 10049142 - DNA, 22 bp, Homo sapiens
cagctcagacgcaggtcgagca

SEQ ID NO: 10049143 - DNA, 22 bp, Homo sapiens
gtgcttcaagttcttaatgttt

SEQ ID NO: 10049144 - DNA, 22 bp, Homo sapiens
taataattggcaatgttgagca

SEQ ID NO: 10049145 - DNA, 22 bp, Homo sapiens
taataattggcaatgttgagca

SEQ ID NO: 10049146 - DNA, 22 bp, Homo sapiens
taataattggctaaccctggga

SEQ ID NO: 10049147 - DNA, 22 bp, Homo sapiens
taataattttaaagaaggctag

SEQ ID NO: 10049148 - DNA, 22 bp, Homo sapiens
taataattaacagtgatgggtc

SEQ ID NO: 10049149 - DNA, 22 bp, Homo sapiens
taataattagttattgatcgtg

SEQ ID NO: 10049150 - DNA, 21 bp, Homo sapiens
taataattccactacagagta

SEQ ID NO: 10049151 - DNA, 22 bp, Homo sapiens
caggcagatttgctgccctcca

SEQ ID NO: 10049152 - DNA, 22 bp, Homo sapiens
caggcagatatgttcgctttaa

SEQ ID NO: 10049153 - DNA, 22 bp, Homo sapiens
caggcagatgctgacaagagtt

SEQ ID NO: 10049154 - DNA, 22 bp, Homo sapiens
taatcacaattcagatgtctta

SEQ ID NO: 10049155 - DNA, 22 bp, Homo sapiens
taatacagacaacttgccaaat

SEQ ID NO: 10049156 - DNA, 22 bp, Homo sapiens
taatccaaaactgaatctgtgg

SEQ ID NO: 10049157 - DNA, 20 bp, Homo sapiens
taatgtcaaagtcacaaggt

SEQ ID NO: 10049158 - DNA, 22 bp, Homo sapiens
taatgtacctccagatgttgta

SEQ ID NO: 10049159 - DNA, 22 bp, Homo sapiens
taatgtactgatgggaagtggt

SEQ ID NO: 10049160 - DNA, 22 bp, Homo sapiens
taatgtgaagacataaatcaga

SEQ ID NO: 10049161 - DNA, 22 bp, Homo sapiens
caggcccaagactgatgagtct

SEQ ID NO: 10049162 - DNA, 22 bp, Homo sapiens
caggccagtgtgcttcccaggc

SEQ ID NO: 10049163 - DNA, 22 bp, Homo sapiens
caggccaggtggcaggcaaaac

SEQ ID NO: 10049164 - DNA, 22 bp, Homo sapiens
caggccagggttgagaagagaa

SEQ ID NO: 10049165 - DNA, 22 bp, Homo sapiens
tacaaaacagtgctctggtcct

SEQ ID NO: 10049166 - DNA, 22 bp, Homo sapiens
tacaaaacagtgctctggtcct

SEQ ID NO: 10049167 - DNA, 20 bp, Homo sapiens
tacaaacctccacactggtg

SEQ ID NO: 10049168 - DNA, 22 bp, Homo sapiens
caggcccagcccttagccaggt

SEQ ID NO: 10049169 - DNA, 22 bp, Homo sapiens
tacattgctttctaatacatct

SEQ ID NO: 10049170 - DNA, 22 bp, Homo sapiens
caggcctgagacatctgagata

SEQ ID NO: 10049171 - DNA, 22 bp, Homo sapiens
caggcctgagtgtggaagtctt

SEQ ID NO: 10049172 - DNA, 22 bp, Homo sapiens
tactttaatatatgtgaagttc

SEQ ID NO: 10049173 - DNA, 18 bp, Homo sapiens
tactttattccccctcca

SEQ ID NO: 10049174 - DNA, 22 bp, Homo sapiens
tacatttcagagctcctctctg

SEQ ID NO: 10049175 - DNA, 22 bp, Homo sapiens
caggctgggactgacccctgct

SEQ ID NO: 10049176 - DNA, 22 bp, Homo sapiens
caggctggcaatgcgtcaagca

SEQ ID NO: 10049177 - DNA, 22 bp, Homo sapiens
caggctggagttcagtggtgtg

SEQ ID NO: 10049178 - DNA, 22 bp, Homo sapiens
caggctggagttcagtggtgtg

SEQ ID NO: 10049179 - DNA, 22 bp, Homo sapiens
caggctgcccggcaagttgcgc

SEQ ID NO: 10049180 - DNA, 22 bp, Homo sapiens
tagaaacaaagacctgggtgct

SEQ ID NO: 10049181 - DNA, 22 bp, Homo sapiens
caggcttgtgtctcagctgcag

SEQ ID NO: 10049182 - DNA, 22 bp, Homo sapiens
caggcttggcagggaggctggt

SEQ ID NO: 10049183 - DNA, 22 bp, Homo sapiens
tagattcagatatttaggacaa

SEQ ID NO: 10049184 - DNA, 22 bp, Homo sapiens
ttactgagggtgtatcttagtg

SEQ ID NO: 10049185 - DNA, 22 bp, Homo sapiens
ttactgaggagcatatctgagt

SEQ ID NO: 10049186 - DNA, 22 bp, Homo sapiens
ttacattttggggtaaggataa

SEQ ID NO: 10049187 - DNA, 22 bp, Homo sapiens
ttactcgtgacaatgtccttga

SEQ ID NO: 10049188 - DNA, 22 bp, Homo sapiens
ttagagagaaccatcaggatct

SEQ ID NO: 10049189 - DNA, 22 bp, Homo sapiens
ttagagccagttacaaggtcaa

SEQ ID NO: 10049190 - DNA, 22 bp, Homo sapiens
ttagaagcatcacctgttctgg

SEQ ID NO: 10049191 - DNA, 22 bp, Homo sapiens
ttagaaaatttgcttctttgga

SEQ ID NO: 10049192 - DNA, 22 bp, Homo sapiens
ttacacagttggtaggggcaga

SEQ ID NO: 10049193 - DNA, 22 bp, Homo sapiens
ttacacagaaattttattgcct

SEQ ID NO: 10049194 - DNA, 22 bp, Homo sapiens
ttacacagatggttagtagagg

SEQ ID NO: 10049195 - DNA, 17 bp, Homo sapiens
ttacacaggagagctct

SEQ ID NO: 10049196 - DNA, 22 bp, Homo sapiens
ttacaggaggtgctaggtgttt

SEQ ID NO: 10049197 - DNA, 22 bp, Homo sapiens
ttacaggtggagaagtaaggct

SEQ ID NO: 10049198 - DNA, 22 bp, Homo sapiens
ttacaggttgtgtattcagtga

SEQ ID NO: 10049199 - DNA, 22 bp, Homo sapiens
ttacatcatgcttatccctttc

SEQ ID NO: 10049200 - DNA, 22 bp, Homo sapiens
ttaaagcatgctgcttttccat

SEQ ID NO: 10049201 - DNA, 22 bp, Homo sapiens
tgttttctgatggttaatgagt

SEQ ID NO: 10049202 - DNA, 22 bp, Homo sapiens
ttaaatctgttctcatgtctgt

SEQ ID NO: 10049203 - DNA, 22 bp, Homo sapiens
ttaaatggggatgagtagatgg

SEQ ID NO: 10049204 - DNA, 22 bp, Homo sapiens
ttaaattaggactctagttctg

SEQ ID NO: 10049205 - DNA, 22 bp, Homo sapiens
ttaaatgtgatttcatttatgt

SEQ ID NO: 10049206 - DNA, 22 bp, Homo sapiens
ttaaggcattctcctactaata

SEQ ID NO: 10049207 - DNA, 22 bp, Homo sapiens
ttaagtgagcttgaataatctt

SEQ ID NO: 10049208 - DNA, 22 bp, Homo sapiens
ttaattcagtcaaagaaaccat

SEQ ID NO: 10049209 - DNA, 22 bp, Homo sapiens
ttaacattgtccttagcagatt

SEQ ID NO: 10049210 - DNA, 22 bp, Homo sapiens
ttaacagacttgggattttcta

SEQ ID NO: 10049211 - DNA, 22 bp, Homo sapiens
ttaacagagtgcctggcatgta

SEQ ID NO: 10049212 - DNA, 22 bp, Homo sapiens
ttaagacacatttctcagacgg

SEQ ID NO: 10049213 - DNA, 22 bp, Homo sapiens
ttaagaaggtactcaaagatct

SEQ ID NO: 10049214 - DNA, 22 bp, Homo sapiens
ttaagaaggctgtttgctagac

SEQ ID NO: 10049215 - DNA, 22 bp, Homo sapiens
tgtggtggctattctggtctca

SEQ ID NO: 10049216 - DNA, 22 bp, Homo sapiens
tgtggtggggtctggtattcca

SEQ ID NO: 10049217 - DNA, 22 bp, Homo sapiens
tgtggttggaatgcagccatgc

SEQ ID NO: 10049218 - DNA, 22 bp, Homo sapiens
tgtggttttggttcagaaacaa

SEQ ID NO: 10049219 - DNA, 22 bp, Homo sapiens
tgtgtaaaatctgattaatact

SEQ ID NO: 10049220 - DNA, 20 bp, Homo sapiens
tgtggtttttgccagttgaa

SEQ ID NO: 10049221 - DNA, 21 bp, Homo sapiens
tgtgtaaagttgaaatcctgt

SEQ ID NO: 10049222 - DNA, 22 bp, Homo sapiens
tgtgtaaatggcatctctcagc

SEQ ID NO: 10049223 - DNA, 22 bp, Homo sapiens
tgtgtaaatttatttacataaa

SEQ ID NO: 10049224 - DNA, 22 bp, Homo sapiens
tgtgtaaatttatttacataaa

SEQ ID NO: 10049225 - DNA, 21 bp, Homo sapiens
tgtgtaattttttaaatggcc

SEQ ID NO: 10049226 - DNA, 22 bp, Homo sapiens
tgtggtgccgagagtctggacg

SEQ ID NO: 10049227 - DNA, 22 bp, Homo sapiens
tgtggggactttcaaagccaat

SEQ ID NO: 10049228 - DNA, 22 bp, Homo sapiens
tgtggcctctaagctcacgaag

SEQ ID NO: 10049229 - DNA, 22 bp, Homo sapiens
tgtgtgaaggagccactgttca

SEQ ID NO: 10049230 - DNA, 22 bp, Homo sapiens
tgtgtgaaggaatatatactca

SEQ ID NO: 10049231 - DNA, 22 bp, Homo sapiens
tgtgtgaatggattattctatt

SEQ ID NO: 10049232 - DNA, 22 bp, Homo sapiens
tgtgtgaatctattgaatatat

SEQ ID NO: 10049233 - DNA, 22 bp, Homo sapiens
tgtgtctttgttccaggtacga

SEQ ID NO: 10049234 - DNA, 22 bp, Homo sapiens
tgtgtgattgcaggagatgtgg

SEQ ID NO: 10049235 - DNA, 22 bp, Homo sapiens
tgtggcagaactgggactcaaa

SEQ ID NO: 10049236 - DNA, 22 bp, Homo sapiens
tgtggcagaaagcatgtggaca

SEQ ID NO: 10049237 - DNA, 21 bp, Homo sapiens
tgtggcagatgttgggaggca

SEQ ID NO: 10049238 - DNA, 22 bp, Homo sapiens
tgtggcagaggaggcagcgtcc

SEQ ID NO: 10049239 - DNA, 22 bp, Homo sapiens
tgtggcagtctcactggagggc

SEQ ID NO: 10049240 - DNA, 18 bp, Homo sapiens
tgtggcaggggtgggaga

SEQ ID NO: 10049241 - DNA, 22 bp, Homo sapiens
tgtggcagctgctgcaggagct

SEQ ID NO: 10049242 - DNA, 22 bp, Homo sapiens
tgtggcagtataagagctagaa

SEQ ID NO: 10049243 - DNA, 22 bp, Homo sapiens
tgtggcagtctcactggagggc

SEQ ID NO: 10049244 - DNA, 22 bp, Homo sapiens
tcccccactctaaaggagcctt

SEQ ID NO: 10049245 - DNA, 22 bp, Homo sapiens
tgtggacgtcattaaagcagtg

SEQ ID NO: 10049246 - DNA, 16 bp, Homo sapiens
tgtttgcaaagcaatc

SEQ ID NO: 10049247 - DNA, 22 bp, Homo sapiens
tgtttgaagttcttctgtgact

SEQ ID NO: 10049248 - DNA, 22 bp, Homo sapiens
tgtttcttgataaagcagaaaa

SEQ ID NO: 10049249 - DNA, 22 bp, Homo sapiens
tgttctagcaacacagttttgg

SEQ ID NO: 10049250 - DNA, 22 bp, Homo sapiens
tgttctgtgcatctagccagta

SEQ ID NO: 10049251 - DNA, 22 bp, Homo sapiens
tgttctggggttgagagacaat

SEQ ID NO: 10049252 - DNA, 22 bp, Homo sapiens
tgtttaatctataaaatggaga

SEQ ID NO: 10049253 - DNA, 22 bp, Homo sapiens
tgtttaatcttcaggacagtct

SEQ ID NO: 10049254 - DNA, 22 bp, Homo sapiens
tgtttaataattctatgatagt

SEQ ID NO: 10049255 - DNA, 22 bp, Homo sapiens
tgtttaataattctatgatagt

SEQ ID NO: 10049256 - DNA, 21 bp, Homo sapiens
tgtttaatacatatttgtgga

SEQ ID NO: 10049257 - DNA, 22 bp, Homo sapiens
tgtttaattcaccatcatgttc

SEQ ID NO: 10049258 - DNA, 22 bp, Homo sapiens
tgtttaattcaccatcatgttc

SEQ ID NO: 10049259 - DNA, 22 bp, Homo sapiens
tgtttaatttcacaaagttgac

SEQ ID NO: 10049260 - DNA, 22 bp, Homo sapiens
tgtttaatgaagatggtttttc

SEQ ID NO: 10049261 - DNA, 22 bp, Homo sapiens
tgttcctggttcctgcatgatg

SEQ ID NO: 10049262 - DNA, 22 bp, Homo sapiens
tgttcacacacggaggccacag

SEQ ID NO: 10049263 - DNA, 22 bp, Homo sapiens
tgttcacaaggtgatgctttga

SEQ ID NO: 10049264 - DNA, 22 bp, Homo sapiens
tgttcacaagatgtctgtggct

SEQ ID NO: 10049265 - DNA, 22 bp, Homo sapiens
tgttcacatcgatggattttgc

SEQ ID NO: 10049266 - DNA, 22 bp, Homo sapiens
tgttatgaacttctagaaaaca

SEQ ID NO: 10049267 - DNA, 22 bp, Homo sapiens
tgttatctgcacgtagagtttt

SEQ ID NO: 10049268 - DNA, 22 bp, Homo sapiens
tgttatctggttgtctgattac

SEQ ID NO: 10049269 - DNA, 22 bp, Homo sapiens
tgttatataacttacaacctgt

SEQ ID NO: 10049270 - DNA, 22 bp, Homo sapiens
tgttatttatctgagcatttat

SEQ ID NO: 10049271 - DNA, 22 bp, Homo sapiens
tgtgttcttaaaagcagtgata

SEQ ID NO: 10049272 - DNA, 22 bp, Homo sapiens
tgtgttctggctgtgacagctg

SEQ ID NO: 10049273 - DNA, 22 bp, Homo sapiens
tgtgttaattttccctttctct

SEQ ID NO: 10049274 - DNA, 22 bp, Homo sapiens
tgtgttctgaaggagaagagtg

SEQ ID NO: 10049275 - DNA, 22 bp, Homo sapiens
tgtgtttgaggcatgttgcaga

SEQ ID NO: 10049276 - DNA, 21 bp, Homo sapiens
tgtgtttgagactatgtttcc

SEQ ID NO: 10049277 - DNA, 22 bp, Homo sapiens
tgtgttttatctattgtatctt

SEQ ID NO: 10049278 - DNA, 22 bp, Homo sapiens
tgtgttttccagaatggtgttt

SEQ ID NO: 10049279 - DNA, 22 bp, Homo sapiens
tgtgttttggaaggaacatgca

SEQ ID NO: 10049280 - DNA, 22 bp, Homo sapiens
tgtgttttggaaggaacatgca

SEQ ID NO: 10049281 - DNA, 22 bp, Homo sapiens
tgtgtttgggggagatgcattt

SEQ ID NO: 10049282 - DNA, 22 bp, Homo sapiens
ttctcttttagaggctccatga

SEQ ID NO: 10049283 - DNA, 22 bp, Homo sapiens
ttctcttttcaccagttgctaa

SEQ ID NO: 10049284 - DNA, 22 bp, Homo sapiens
ttctataatgcaagccactgca

SEQ ID NO: 10049285 - DNA, 22 bp, Homo sapiens
ttctgagaagtaaaatggcgtt

SEQ ID NO: 10049286 - DNA, 22 bp, Homo sapiens
ttctgagaaggctgtggacaca

SEQ ID NO: 10049287 - DNA, 22 bp, Homo sapiens
ttctgagatgtgaatctgtcaa

SEQ ID NO: 10049288 - DNA, 22 bp, Homo sapiens
ttctgagatgcgttagaaattt

SEQ ID NO: 10049289 - DNA, 22 bp, Homo sapiens
ttctgagatacttttggcacca

SEQ ID NO: 10049290 - DNA, 22 bp, Homo sapiens
ttctgagatacaaaatttactt

SEQ ID NO: 10049291 - DNA, 22 bp, Homo sapiens
ttctgagagttgtagtgtatcc

SEQ ID NO: 10049292 - DNA, 22 bp, Homo sapiens
ttctgagacttgagattaattt

SEQ ID NO: 10049293 - DNA, 22 bp, Homo sapiens
ttctgagagtaaacatagcctg

SEQ ID NO: 10049294 - DNA, 22 bp, Homo sapiens
ttctgagagagcctctcatgtt

SEQ ID NO: 10049295 - DNA, 22 bp, Homo sapiens
ttctgagattgttaggcactaa

SEQ ID NO: 10049296 - DNA, 22 bp, Homo sapiens
ttctgctgcgacccaggagtta

SEQ ID NO: 10049297 - DNA, 22 bp, Homo sapiens
ttctgctgctgctgcacccaat

SEQ ID NO: 10049298 - DNA, 21 bp, Homo sapiens
ttctgctgttcaccaccaccc

SEQ ID NO: 10049299 - DNA, 21 bp, Homo sapiens
ttctgctgtgccatgcctctg

SEQ ID NO: 10049300 - DNA, 21 bp, Homo sapiens
ttctgctgtgccatgcctctg

SEQ ID NO: 10049301 - DNA, 22 bp, Homo sapiens
ttctgcttctgtgtgtcccagg

SEQ ID NO: 10049302 - DNA, 22 bp, Homo sapiens
ttctttaaatgaattctctgta

SEQ ID NO: 10049303 - DNA, 22 bp, Homo sapiens
ttctttaaatgaattctctgta

SEQ ID NO: 10049304 - DNA, 22 bp, Homo sapiens
ttctttaaaatagtgagaaaga

SEQ ID NO: 10049305 - DNA, 18 bp, Homo sapiens
ttctttaattcagtttga

SEQ ID NO: 10049306 - DNA, 18 bp, Homo sapiens
ttctttaattcagtttga

SEQ ID NO: 10049307 - DNA, 18 bp, Homo sapiens
ttctttaattcagtttga

SEQ ID NO: 10049308 - DNA, 22 bp, Homo sapiens
ttctttaaatgaattctctgta

SEQ ID NO: 10049309 - DNA, 22 bp, Homo sapiens
ttctttatatctgctagtgggt

SEQ ID NO: 10049310 - DNA, 22 bp, Homo sapiens
ttctttaggtagatccagtttt

SEQ ID NO: 10049311 - DNA, 23 bp, Homo sapiens
ttctttataaatcaatgggatgt

SEQ ID NO: 10049312 - DNA, 22 bp, Homo sapiens
ttctttatagctattggatgag

SEQ ID NO: 10049313 - DNA, 22 bp, Homo sapiens
ttcttgaccatgtatgtggtcc

SEQ ID NO: 10049314 - DNA, 22 bp, Homo sapiens
ttcttctttcctataattaatt

SEQ ID NO: 10049315 - DNA, 22 bp, Homo sapiens
ttcttacatattttcatatggt

SEQ ID NO: 10049316 - DNA, 21 bp, Homo sapiens
ttcttcttggactgttttggc

SEQ ID NO: 10049317 - DNA, 22 bp, Homo sapiens
ttcttacagagtttacagagcc

SEQ ID NO: 10049318 - DNA, 22 bp, Homo sapiens
ttctgttacctttgtgagtttc

SEQ ID NO: 10049319 - DNA, 22 bp, Homo sapiens
ttctttattgagacttcattgt

SEQ ID NO: 10049320 - DNA, 22 bp, Homo sapiens
ttctttatgcttctgtttaggc

SEQ ID NO: 10049321 - DNA, 22 bp, Homo sapiens
ttctttatggaatggtgatagt

SEQ ID NO: 10049322 - DNA, 22 bp, Homo sapiens
ttctttatcagttactcatagg

SEQ ID NO: 10049323 - DNA, 22 bp, Homo sapiens
ttctttatcctatttgtaggtg

SEQ ID NO: 10049324 - DNA, 22 bp, Homo sapiens
ttctttattagtttagtgagct

SEQ ID NO: 10049325 - DNA, 22 bp, Homo sapiens
ttctttatgttaatgaatctat

SEQ ID NO: 10049326 - DNA, 22 bp, Homo sapiens
ttgagttccaggatggttgtta

SEQ ID NO: 10049327 - DNA, 22 bp, Homo sapiens
ttgagttcaggggttgattgga

SEQ ID NO: 10049328 - DNA, 22 bp, Homo sapiens
ttgatcatctaagagtaatagt

SEQ ID NO: 10049329 - DNA, 22 bp, Homo sapiens
ttgatgcttaaggtaaaacaga

SEQ ID NO: 10049330 - DNA, 22 bp, Homo sapiens
ttgatgtcagtattatgagttt

SEQ ID NO: 10049331 - DNA, 22 bp, Homo sapiens
ttgattctggtgactgatggaa

SEQ ID NO: 10049332 - DNA, 23 bp, Homo sapiens
ttgattctccagtatgggctgag

SEQ ID NO: 10049333 - DNA, 22 bp, Homo sapiens
ttgattctgatcctgtctggag

SEQ ID NO: 10049334 - DNA, 22 bp, Homo sapiens
ttgcaaatggtaccaagggtct

SEQ ID NO: 10049335 - DNA, 22 bp, Homo sapiens
ttgcaaatcacaagagcagagc

SEQ ID NO: 10049336 - DNA, 22 bp, Homo sapiens
ttgcaaatctttgccagaaggc

SEQ ID NO: 10049337 - DNA, 22 bp, Homo sapiens
ttcaattctaaactaatattct

SEQ ID NO: 10049338 - DNA, 22 bp, Homo sapiens
ttcaattcaattctaaatatat

SEQ ID NO: 10049339 - DNA, 22 bp, Homo sapiens
ttcaatttagtgatgttgttgg

SEQ ID NO: 10049340 - DNA, 22 bp, Homo sapiens
ttcaacaattaagtatcagcct

SEQ ID NO: 10049341 - DNA, 22 bp, Homo sapiens
ttcaacacaggaacatgatata

SEQ ID NO: 10049342 - DNA, 21 bp, Homo sapiens
ttcaacaaagggaataagttt

SEQ ID NO: 10049343 - DNA, 22 bp, Homo sapiens
ttcaacaatgaaagctaaggaa

SEQ ID NO: 10049344 - DNA, 22 bp, Homo sapiens
ttcaacaacttggttcaaatgg

SEQ ID NO: 10049345 - DNA, 22 bp, Homo sapiens
ttcaacaaggctgtcaaaagtt

SEQ ID NO: 10049346 - DNA, 23 bp, Homo sapiens
ttcaaagcttaagctctttccac

SEQ ID NO: 10049347 - DNA, 22 bp, Homo sapiens
ttcacattcagaaaaagcccgt

SEQ ID NO: 10049348 - DNA, 22 bp, Homo sapiens
ttcagtcctcacaacctcacta

SEQ ID NO: 10049349 - DNA, 22 bp, Homo sapiens
ttcagtatttcatgactttctt

SEQ ID NO: 10049350 - DNA, 22 bp, Homo sapiens
ttcagtatacttcataacattt

SEQ ID NO: 10049351 - DNA, 22 bp, Homo sapiens
ttcagtatacattatctaattg

SEQ ID NO: 10049352 - DNA, 22 bp, Homo sapiens
ttcagtatccctgcttggacag

SEQ ID NO: 10049353 - DNA, 22 bp, Homo sapiens
ttcagtatgattcctccagtag

SEQ ID NO: 10049354 - DNA, 21 bp, Homo sapiens
ttcagtatgcgtcatgctgtt

SEQ ID NO: 10049355 - DNA, 22 bp, Homo sapiens
ttcagtaaggataataaacaga

SEQ ID NO: 10049356 - DNA, 22 bp, Homo sapiens
ttcatgtgtctgtagcacatat

SEQ ID NO: 10049357 - DNA, 22 bp, Homo sapiens
ttcatgctgtgtctacaactta

SEQ ID NO: 10049358 - DNA, 22 bp, Homo sapiens
ttccagagcccatgctctaggc

SEQ ID NO: 10049359 - DNA, 22 bp, Homo sapiens
ttccagagagttattcccctgg

SEQ ID NO: 10049360 - DNA, 22 bp, Homo sapiens
ttccagaattttgttctgcttg

SEQ ID NO: 10049361 - DNA, 22 bp, Homo sapiens
ttccagaccattccacgggaga

SEQ ID NO: 10049362 - DNA, 22 bp, Homo sapiens
ttcctcatctgtgcacctcact

SEQ ID NO: 10049363 - DNA, 22 bp, Homo sapiens
ttcctagacagttcttcccaaa

SEQ ID NO: 10049364 - DNA, 23 bp, Homo sapiens
ttccttaactgttaagattgtct

SEQ ID NO: 10049365 - DNA, 22 bp, Homo sapiens
ttccttagatccttcaatcacg

SEQ ID NO: 10049366 - DNA, 22 bp, Homo sapiens
ttcctctttctctgtgctatgt

SEQ ID NO: 10049367 - DNA, 22 bp, Homo sapiens
ttcctgtgcctcaggtctcagc

SEQ ID NO: 10049368 - DNA, 22 bp, Homo sapiens
ttcctgtggccttacatctgtg

SEQ ID NO: 10049369 - DNA, 22 bp, Homo sapiens
ttcctgtgtgactcaagtggtt

SEQ ID NO: 10049370 - DNA, 17 bp, Homo sapiens
ttcctgtggtttgatct

SEQ ID NO: 10049371 - DNA, 22 bp, Homo sapiens
tttaattatatctgggcagtta

SEQ ID NO: 10049372 - DNA, 22 bp, Homo sapiens
tttaattttctgggcccagcag

SEQ ID NO: 10049373 - DNA, 22 bp, Homo sapiens
tttaaaagttatcatctgtcca

SEQ ID NO: 10049374 - DNA, 22 bp, Homo sapiens
tttaaacaaataggattgccta

SEQ ID NO: 10049375 - DNA, 22 bp, Homo sapiens
tttacaaggcagaactgattaa

SEQ ID NO: 10049376 - DNA, 22 bp, Homo sapiens
tttaccagtgaggaaaatgagg

SEQ ID NO: 10049377 - DNA, 22 bp, Homo sapiens
tttactttctcaagtatatagg

SEQ ID NO: 10049378 - DNA, 22 bp, Homo sapiens
tttagttattgttacagtatga

SEQ ID NO: 10049379 - DNA, 22 bp, Homo sapiens
tttattaaaactgttggctctg

SEQ ID NO: 10049380 - DNA, 21 bp, Homo sapiens
tttattaacaactgtggacgt

SEQ ID NO: 10049381 - DNA, 21 bp, Homo sapiens
tttattaacaactgtggacgt

SEQ ID NO: 10049382 - DNA, 22 bp, Homo sapiens
tttattaatgtagcatccatgg

SEQ ID NO: 10049383 - DNA, 22 bp, Homo sapiens
tttattaagatgcgaatgctga

SEQ ID NO: 10049384 - DNA, 22 bp, Homo sapiens
tttattaagatgcgaatgctga

SEQ ID NO: 10049385 - DNA, 22 bp, Homo sapiens
tttatagttatatacagatgtt

SEQ ID NO: 10049386 - DNA, 22 bp, Homo sapiens
tttatagtcgtctcagtaataa

SEQ ID NO: 10049387 - DNA, 17 bp, Homo sapiens
tttataattggcctctt

SEQ ID NO: 10049388 - DNA, 22 bp, Homo sapiens
tttatacatggagaatttttgc

SEQ ID NO: 10049389 - DNA, 21 bp, Homo sapiens
tttagttcaagtacagaacca

SEQ ID NO: 10049390 - DNA, 22 bp, Homo sapiens
tttataaacagtaccacggtgc

SEQ ID NO: 10049391 - DNA, 22 bp, Homo sapiens
tttataaaatagactgggtcta

SEQ ID NO: 10049392 - DNA, 22 bp, Homo sapiens
tttataaaatagactgggtcta

SEQ ID NO: 10049393 - DNA, 22 bp, Homo sapiens
tttattatccagtgttgtcatg

SEQ ID NO: 10049394 - DNA, 22 bp, Homo sapiens
tttattattctctggagaatgt

SEQ ID NO: 10049395 - DNA, 22 bp, Homo sapiens
tttattagattatcaaagaggt

SEQ ID NO: 10049396 - DNA, 22 bp, Homo sapiens
tttattaattagtgacccaatg

SEQ ID NO: 10049397 - DNA, 22 bp, Homo sapiens
ttgtgaaatcgtgtttggaagc

SEQ ID NO: 10049398 - DNA, 22 bp, Homo sapiens
ttgtctgtaaagacggccacca

SEQ ID NO: 10049399 - DNA, 22 bp, Homo sapiens
ttggtttgttcaccatcaagca

SEQ ID NO: 10049400 - DNA, 20 bp, Homo sapiens
ttggtcagtggttcagtttg

SEQ ID NO: 10049401 - DNA, 22 bp, Homo sapiens
ttgttttcctgggataccaacc

SEQ ID NO: 10049402 - DNA, 22 bp, Homo sapiens
ttgttttggaagaacttactct

SEQ ID NO: 10049403 - DNA, 22 bp, Homo sapiens
ttgttttggagatgagctaaaa

SEQ ID NO: 10049404 - DNA, 22 bp, Homo sapiens
ttgtttttaaacatgtgactga

SEQ ID NO: 10049405 - DNA, 22 bp, Homo sapiens
ttgtttttaaacatgtgactga

SEQ ID NO: 10049406 - DNA, 22 bp, Homo sapiens
ttgtgttaaggtgcatctagtg

SEQ ID NO: 10049407 - DNA, 22 bp, Homo sapiens
ttgtgtttctggccaagatgga

SEQ ID NO: 10049408 - DNA, 22 bp, Homo sapiens
ttgtgtgtgtaactttatgaga

SEQ ID NO: 10049409 - DNA, 22 bp, Homo sapiens
ttgtgtgtttgtagaaaatcca

SEQ ID NO: 10049410 - DNA, 19 bp, Homo sapiens
ttgtgtgtcagtcagagtt

SEQ ID NO: 10049411 - DNA, 22 bp, Homo sapiens
ttgtgtgtgagccttcaccaca

SEQ ID NO: 10049412 - DNA, 22 bp, Homo sapiens
ttgtgtgtcttcttcactgccc

SEQ ID NO: 10049413 - DNA, 22 bp, Homo sapiens
tttcttctcatccctgaaatca

SEQ ID NO: 10049414 - DNA, 22 bp, Homo sapiens
tttcttctaagatttcaaacta

SEQ ID NO: 10049415 - DNA, 22 bp, Homo sapiens
tttcttctaggactaataagag

SEQ ID NO: 10049416 - DNA, 22 bp, Homo sapiens
tttcttcctgctttgtcccatg

SEQ ID NO: 10049417 - DNA, 22 bp, Homo sapiens
tttcttctctaatctcaatgat

SEQ ID NO: 10049418 - DNA, 22 bp, Homo sapiens
tttctttatcatagcatctttg

SEQ ID NO: 10049419 - DNA, 22 bp, Homo sapiens
tttctttaggctgtgttgccaa

SEQ ID NO: 10049420 - DNA, 22 bp, Homo sapiens
tttctttaattctcacagcaat

SEQ ID NO: 10049421 - DNA, 22 bp, Homo sapiens
tttctttaaaggaactctgttt

SEQ ID NO: 10049422 - DNA, 22 bp, Homo sapiens
tttctttaattctcacagcaat

SEQ ID NO: 10049423 - DNA, 23 bp, Homo sapiens
tttctgttcctctagctttgcat

SEQ ID NO: 10049424 - DNA, 22 bp, Homo sapiens
tttcttccccactgcaggctct

SEQ ID NO: 10049425 - DNA, 22 bp, Homo sapiens
tttcttccaaaggcacgttctc

SEQ ID NO: 10049426 - DNA, 22 bp, Homo sapiens
tttcttatgtgcagagtgagta

SEQ ID NO: 10049427 - DNA, 22 bp, Homo sapiens
tttcttatggggtagtccttta

SEQ ID NO: 10049428 - DNA, 22 bp, Homo sapiens
tttctggcagcgggacaggggt

SEQ ID NO: 10049429 - DNA, 22 bp, Homo sapiens
tttctgaataactctatgatat

SEQ ID NO: 10049430 - DNA, 22 bp, Homo sapiens
tttctctttgacaggaatcaga

SEQ ID NO: 10049431 - DNA, 22 bp, Homo sapiens
tttctctttcaatctgcagtac

SEQ ID NO: 10049432 - DNA, 22 bp, Homo sapiens
tttctcttgcgatatgctacac

SEQ ID NO: 10049433 - DNA, 22 bp, Homo sapiens
tttctctttcaatctgcagtac

SEQ ID NO: 10049434 - DNA, 22 bp, Homo sapiens
tttctcttcactgtgtgcctca

SEQ ID NO: 10049435 - DNA, 22 bp, Homo sapiens
tttctcttcactgtgtgcctca

SEQ ID NO: 10049436 - DNA, 22 bp, Homo sapiens
tttctgaagggcagcagactct

SEQ ID NO: 10049437 - DNA, 22 bp, Homo sapiens
tttctcttaatgtctctgtgct

SEQ ID NO: 10049438 - DNA, 22 bp, Homo sapiens
tttctctagctattcattaaat

SEQ ID NO: 10049439 - DNA, 22 bp, Homo sapiens
tttctccatcaccccctcggtg

SEQ ID NO: 10049440 - DNA, 22 bp, Homo sapiens
tttctccacttctcttgccaac

SEQ ID NO: 10049441 - DNA, 22 bp, Homo sapiens
tttctccacgccagcttgctta

SEQ ID NO: 10049442 - DNA, 22 bp, Homo sapiens
tttctcagctgtggagcctatc

SEQ ID NO: 10049443 - DNA, 22 bp, Homo sapiens
tttcaaaggaggctgagaggat

SEQ ID NO: 10049444 - DNA, 20 bp, Homo sapiens
tttcaaaggcacctatgaag

SEQ ID NO: 10049445 - DNA, 22 bp, Homo sapiens
tttcagccagtgatgctgaaga

SEQ ID NO: 10049446 - DNA, 22 bp, Homo sapiens
ttttttgtcttgaagaaatggt

SEQ ID NO: 10049447 - DNA, 22 bp, Homo sapiens
ttttttgtcttgaagaaatggt

SEQ ID NO: 10049448 - DNA, 22 bp, Homo sapiens
tttttcttgtgctggatctaat

SEQ ID NO: 10049449 - DNA, 22 bp, Homo sapiens
tttttctactgcccacattgta

SEQ ID NO: 10049450 - DNA, 22 bp, Homo sapiens
tttttcatctgattgataactc

SEQ ID NO: 10049451 - DNA, 22 bp, Homo sapiens
tttttcatgagactagaagtca

SEQ ID NO: 10049452 - DNA, 22 bp, Homo sapiens
tttttcattgcagcctctctcc

SEQ ID NO: 10049453 - DNA, 22 bp, Homo sapiens
tttttccaccgtacttcctgag

SEQ ID NO: 10049454 - DNA, 22 bp, Homo sapiens
ttttgaaagccaggtttgtatg

SEQ ID NO: 10049455 - DNA, 22 bp, Homo sapiens
ttttgaaagagtcctgctacag

SEQ ID NO: 10049456 - DNA, 22 bp, Homo sapiens
ttttgaaagccaggtttgtatg

SEQ ID NO: 10049457 - DNA, 22 bp, Homo sapiens
ttttgaaagggtgatttggctt

SEQ ID NO: 10049458 - DNA, 22 bp, Homo sapiens
ttttgaaagggtgatttggctt

SEQ ID NO: 10049459 - DNA, 22 bp, Homo sapiens
ttttatctacctatgctcattt

SEQ ID NO: 10049460 - DNA, 22 bp, Homo sapiens
ttttccttctgatactccattt

SEQ ID NO: 10049461 - DNA, 22 bp, Homo sapiens
ttttgaaagagtcctgctacag

SEQ ID NO: 10049462 - DNA, 22 bp, Homo sapiens
ttttctttaatctggtggggtg

SEQ ID NO: 10049463 - DNA, 22 bp, Homo sapiens
ttttcttctacctgctgtccaa

SEQ ID NO: 10049464 - DNA, 22 bp, Homo sapiens
ttttcttcggtgctgggttgat

SEQ ID NO: 10049465 - DNA, 22 bp, Homo sapiens
tttgtttacaaaaataagcagt

SEQ ID NO: 10049466 - DNA, 22 bp, Homo sapiens
tttgtatttttcccagctagct

SEQ ID NO: 10049467 - DNA, 22 bp, Homo sapiens
tttgtattccatatcatgccat

SEQ ID NO: 10049468 - DNA, 22 bp, Homo sapiens
tttgtattacaaagtcacagta

SEQ ID NO: 10049469 - DNA, 22 bp, Homo sapiens
ttttatattgagtgagagttcc

SEQ ID NO: 10049470 - DNA, 22 bp, Homo sapiens
ttttatatggcacattggttgg

SEQ ID NO: 10049471 - DNA, 22 bp, Homo sapiens
ttttatatggcacattggttgg

SEQ ID NO: 10049472 - DNA, 22 bp, Homo sapiens
ttttataaagagagtcagttgg

SEQ ID NO: 10049473 - DNA, 22 bp, Homo sapiens
tttgtttagatggtaaatcagt

SEQ ID NO: 10049474 - DNA, 22 bp, Homo sapiens
tttgtttagaaagagattggtg

SEQ ID NO: 10049475 - DNA, 22 bp, Homo sapiens
tttgtttagagaattgaagcag

SEQ ID NO: 10049476 - DNA, 22 bp, Homo sapiens
ttttaaactatagctggatgct

SEQ ID NO: 10049477 - DNA, 22 bp, Homo sapiens
tttgcaaatgctctgcagagct

SEQ ID NO: 10049478 - DNA, 22 bp, Homo sapiens
tttgcaaatttcgtctcctcag

SEQ ID NO: 10049479 - DNA, 22 bp, Homo sapiens
tttgcaatgtgaaattaaagaa

SEQ ID NO: 10049480 - DNA, 22 bp, Homo sapiens
tttgcaatggtagttgttgctc

SEQ ID NO: 10049481 - DNA, 22 bp, Homo sapiens
tttgcagagtacctgaagagga

SEQ ID NO: 10049482 - DNA, 22 bp, Homo sapiens
tttgcagaagaaaacatgaaca

SEQ ID NO: 10049483 - DNA, 22 bp, Homo sapiens
tttgcaaaatgaggtgaagagt

SEQ ID NO: 10049484 - DNA, 22 bp, Homo sapiens
tttctttatcctcctttgcaca

SEQ ID NO: 10049485 - DNA, 22 bp, Homo sapiens
tttctttatcctcctttgcaca

SEQ ID NO: 10049486 - DNA, 22 bp, Homo sapiens
ataatgtctgcagagccacaca

SEQ ID NO: 10049487 - DNA, 22 bp, Homo sapiens
ataatttaattttcacagtggt

SEQ ID NO: 10049488 - DNA, 22 bp, Homo sapiens
ctggaacaagtggccttgcaag

SEQ ID NO: 10049489 - DNA, 21 bp, Homo sapiens
ctggaacaaatactagcaaac

SEQ ID NO: 10049490 - DNA, 22 bp, Homo sapiens
ctggaacacctgagttaccact

SEQ ID NO: 10049491 - DNA, 22 bp, Homo sapiens
ctggaagaactccagttctgtg

SEQ ID NO: 10049492 - DNA, 22 bp, Homo sapiens
ctggaagacgtttgaagccatg

SEQ ID NO: 10049493 - DNA, 22 bp, Homo sapiens
atacatctatgcctttctgaca

SEQ ID NO: 10049494 - DNA, 22 bp, Homo sapiens
ctggagctggtatagggacaaa

SEQ ID NO: 10049495 - DNA, 22 bp, Homo sapiens
atagaaaacagatgtccttaaa

SEQ ID NO: 10049496 - DNA, 22 bp, Homo sapiens
atagaaaacagatgtccttaaa

SEQ ID NO: 10049497 - DNA, 22 bp, Homo sapiens
ctggagcttattgggagcagaa

SEQ ID NO: 10049498 - DNA, 21 bp, Homo sapiens
ctggagcttggtgagaagtgt

SEQ ID NO: 10049499 - DNA, 19 bp, Homo sapiens
atagggcaccctaaggagt

SEQ ID NO: 10049500 - DNA, 22 bp, Homo sapiens
atagacaatggtttgccaagaa

SEQ ID NO: 10049501 - DNA, 22 bp, Homo sapiens
atagacaaacacgaagatgaca

SEQ ID NO: 10049502 - DNA, 22 bp, Homo sapiens
agtgttaatggtgtatattagg

SEQ ID NO: 10049503 - DNA, 21 bp, Homo sapiens
agtgttaatggaaattatatt

SEQ ID NO: 10049504 - DNA, 22 bp, Homo sapiens
agtgttaagagaaaattctgct

SEQ ID NO: 10049505 - DNA, 22 bp, Homo sapiens
agtgttagattcttactcagtt

SEQ ID NO: 10049506 - DNA, 22 bp, Homo sapiens
agtgttcatttattcattcact

SEQ ID NO: 10049507 - DNA, 22 bp, Homo sapiens
agtttcaattcttttcacaaag

SEQ ID NO: 10049508 - DNA, 22 bp, Homo sapiens
agtttcagttctgtcatttata

SEQ ID NO: 10049509 - DNA, 22 bp, Homo sapiens
ctgagttctaggctgccacctt

SEQ ID NO: 10049510 - DNA, 22 bp, Homo sapiens
ctgatacaatgctaataaattt

SEQ ID NO: 10049511 - DNA, 22 bp, Homo sapiens
ctgatacactccctaaaatata

SEQ ID NO: 10049512 - DNA, 22 bp, Homo sapiens
ctgcccggagctggcaaaggct

SEQ ID NO: 10049513 - DNA, 22 bp, Homo sapiens
ataataactcctgttgaagaac

SEQ ID NO: 10049514 - DNA, 22 bp, Homo sapiens
ataataacacctgaataggaaa

SEQ ID NO: 10049515 - DNA, 18 bp, Homo sapiens
ctgcctgctctccagctt

SEQ ID NO: 10049516 - DNA, 22 bp, Homo sapiens
ataagctctggacagccacatt

SEQ ID NO: 10049517 - DNA, 22 bp, Homo sapiens
ctgtgtgtgaacacagcccagc

SEQ ID NO: 10049518 - DNA, 22 bp, Homo sapiens
ctgtttatctaggagttgcagg

SEQ ID NO: 10049519 - DNA, 22 bp, Homo sapiens
ctgttatttgagagtgttgaat

SEQ ID NO: 10049520 - DNA, 22 bp, Homo sapiens
ctgtttatggaggtaaggcatc

SEQ ID NO: 10049521 - DNA, 22 bp, Homo sapiens
ctgtttattacgtaattaatat

SEQ ID NO: 10049522 - DNA, 22 bp, Homo sapiens
ctgtttattgagcaatctgcca

SEQ ID NO: 10049523 - DNA, 20 bp, Homo sapiens
ctgtttattagaagtggatt

SEQ ID NO: 10049524 - DNA, 22 bp, Homo sapiens
ctgtttattctcatctaaaatg

SEQ ID NO: 10049525 - DNA, 22 bp, Homo sapiens
atcaggatcagggctagcagag

SEQ ID NO: 10049526 - DNA, 22 bp, Homo sapiens
ctgtgggagcacatgacagata

SEQ ID NO: 10049527 - DNA, 22 bp, Homo sapiens
ctgtgccttggcgctgtgccac

SEQ ID NO: 10049528 - DNA, 22 bp, Homo sapiens
ctgtgcctgccttgttcactga

SEQ ID NO: 10049529 - DNA, 22 bp, Homo sapiens
ctgtgcctggggggcagagctg

SEQ ID NO: 10049530 - DNA, 22 bp, Homo sapiens
ctgtgcctaagatgcatgtctc

SEQ ID NO: 10049531 - DNA, 22 bp, Homo sapiens
cttcagtttatcccatcatcca

SEQ ID NO: 10049532 - DNA, 21 bp, Homo sapiens
atctggaaattctgccagaga

SEQ ID NO: 10049533 - DNA, 22 bp, Homo sapiens
cttcagtttatcccatcatcca

SEQ ID NO: 10049534 - DNA, 22 bp, Homo sapiens
cttcagaattcctcagcctcag

SEQ ID NO: 10049535 - DNA, 22 bp, Homo sapiens
atccttcagtggaagacagtag

SEQ ID NO: 10049536 - DNA, 22 bp, Homo sapiens
atccttcaattagaaccaattg

SEQ ID NO: 10049537 - DNA, 22 bp, Homo sapiens
ctgtccagcttggctcctgggg

SEQ ID NO: 10049538 - DNA, 22 bp, Homo sapiens
ctgtcatttaagacattctgga

SEQ ID NO: 10049539 - DNA, 21 bp, Homo sapiens
ctgtccacatcacagagcctc

SEQ ID NO: 10049540 - DNA, 22 bp, Homo sapiens
ctgtccacatggagaacctggt

SEQ ID NO: 10049541 - DNA, 22 bp, Homo sapiens
ctgggctgtcccagggcggcag

SEQ ID NO: 10049542 - DNA, 22 bp, Homo sapiens
ctggggaggcagggctgcccct

SEQ ID NO: 10049543 - DNA, 22 bp, Homo sapiens
ctggtggcaatgaggcgtcact

SEQ ID NO: 10049544 - DNA, 22 bp, Homo sapiens
ctggtggggagtcctggtctcc

SEQ ID NO: 10049545 - DNA, 22 bp, Homo sapiens
ctggggcagagcctttagcaaa

SEQ ID NO: 10049546 - DNA, 22 bp, Homo sapiens
ctggggcagagcctttagcaaa

SEQ ID NO: 10049547 - DNA, 22 bp, Homo sapiens
atatcacaggtgtttacctgat

SEQ ID NO: 10049548 - DNA, 23 bp, Homo sapiens
atatcacacccagtacagtctcc

SEQ ID NO: 10049549 - DNA, 22 bp, Homo sapiens
atatcaaagctagtggaaattt

SEQ ID NO: 10049550 - DNA, 22 bp, Homo sapiens
atatattttttgagacagagtc

SEQ ID NO: 10049551 - DNA, 22 bp, Homo sapiens
atatattttgcggtcacgtggc

SEQ ID NO: 10049552 - DNA, 22 bp, Homo sapiens
ctccagttggccccagttggtt

SEQ ID NO: 10049553 - DNA, 22 bp, Homo sapiens
ctcccaggttacatctgagcct

SEQ ID NO: 10049554 - DNA, 22 bp, Homo sapiens
agtctgagttagtggaaatgta

SEQ ID NO: 10049555 - DNA, 22 bp, Homo sapiens
agtcattttgccagtcttcagg

SEQ ID NO: 10049556 - DNA, 22 bp, Homo sapiens
agtccaaagcagatgagggcca

SEQ ID NO: 10049557 - DNA, 22 bp, Homo sapiens
agtctgtgactcattggatctc

SEQ ID NO: 10049558 - DNA, 23 bp, Homo sapiens
agtctgtgcttggtgggagggcc

SEQ ID NO: 10049559 - DNA, 22 bp, Homo sapiens
agtcttaactatgcaagtacta

SEQ ID NO: 10049560 - DNA, 22 bp, Homo sapiens
agtcttaatagagaaaaactgt

SEQ ID NO: 10049561 - DNA, 21 bp, Homo sapiens
agtggctgtcaagggggcctt

SEQ ID NO: 10049562 - DNA, 22 bp, Homo sapiens
ctctgagaggctgccctgccat

SEQ ID NO: 10049563 - DNA, 22 bp, Homo sapiens
ctctgagacttttcacctccca

SEQ ID NO: 10049564 - DNA, 22 bp, Homo sapiens
ctctgagacttagcatctacat

SEQ ID NO: 10049565 - DNA, 22 bp, Homo sapiens
ctctgagactcaagtgagtggg

SEQ ID NO: 10049566 - DNA, 23 bp, Homo sapiens
ctctgagacccaggtggacacgg

SEQ ID NO: 10049567 - DNA, 22 bp, Homo sapiens
ctctgagaaagctgtgagctaa

SEQ ID NO: 10049568 - DNA, 22 bp, Homo sapiens
ctctgagaagccttgatgggga

SEQ ID NO: 10049569 - DNA, 22 bp, Homo sapiens
ctctgagaagagttcaagtaaa

SEQ ID NO: 10049570 - DNA, 22 bp, Homo sapiens
agtgggcagcccaggaggtctt

SEQ ID NO: 10049571 - DNA, 22 bp, Homo sapiens
agtgggcaaaacagctcagagc

SEQ ID NO: 10049572 - DNA, 22 bp, Homo sapiens
agtgggcatatgaagtctcaag

SEQ ID NO: 10049573 - DNA, 22 bp, Homo sapiens
agtggggaagagcatgggccct

SEQ ID NO: 10049574 - DNA, 22 bp, Homo sapiens
agtggcagccgagcaggagatg

SEQ ID NO: 10049575 - DNA, 22 bp, Homo sapiens
agtggctgacaactgggttaac

SEQ ID NO: 10049576 - DNA, 22 bp, Homo sapiens
ctgagagcctcctgttggctag

SEQ ID NO: 10049577 - DNA, 22 bp, Homo sapiens
ctgagagcatcgctggagatag

SEQ ID NO: 10049578 - DNA, 22 bp, Homo sapiens
agtgtgtgtttgggcggtttat

SEQ ID NO: 10049579 - DNA, 22 bp, Homo sapiens
agtgtgttctcaatgaaaagaa

SEQ ID NO: 10049580 - DNA, 22 bp, Homo sapiens
agtgtgtttaggctgcgggttg

SEQ ID NO: 10049581 - DNA, 22 bp, Homo sapiens
agtgtgtttggagcgagggagg

SEQ ID NO: 10049582 - DNA, 18 bp, Homo sapiens
agtgtgtgccctttcagg

SEQ ID NO: 10049583 - DNA, 22 bp, Homo sapiens
agtgtgtgctgttccccggagg

SEQ ID NO: 10049584 - DNA, 22 bp, Homo sapiens
ctcttaatgaccttaattcaag

SEQ ID NO: 10049585 - DNA, 22 bp, Homo sapiens
agtgtctgccagctgccaggtg

SEQ ID NO: 10049586 - DNA, 20 bp, Homo sapiens
agtggggagtcaggagtgcc

SEQ ID NO: 10049587 - DNA, 22 bp, Homo sapiens
agtggggaagattttgcagtca

SEQ ID NO: 10049588 - DNA, 22 bp, Homo sapiens
agtggggacaatgagagcaggt

SEQ ID NO: 10049589 - DNA, 23 bp, Homo sapiens
agtgtctgagtgcaggctgtgca

SEQ ID NO: 10049590 - DNA, 22 bp, Homo sapiens
agtgtctgaacctgcagtggga

SEQ ID NO: 10049591 - DNA, 22 bp, Homo sapiens
agtgtctgaactgggtgctgac

SEQ ID NO: 10049592 - DNA, 22 bp, Homo sapiens
aggtggggttcagtctcagccg

SEQ ID NO: 10049593 - DNA, 22 bp, Homo sapiens
aggtgtggcttgaagtctctat

SEQ ID NO: 10049594 - DNA, 22 bp, Homo sapiens
aggtgtgggaaacgggtgacct

SEQ ID NO: 10049595 - DNA, 22 bp, Homo sapiens
aggtgtggcttgaagtctctat

SEQ ID NO: 10049596 - DNA, 22 bp, Homo sapiens
aggtgtgtataaacatacatat

SEQ ID NO: 10049597 - DNA, 22 bp, Homo sapiens
aggttgggatgagtgggtgagc

SEQ ID NO: 10049598 - DNA, 22 bp, Homo sapiens
agtaatgattatgtacagaatg

SEQ ID NO: 10049599 - DNA, 22 bp, Homo sapiens
cgcctgctctcactggacagct

SEQ ID NO: 10049600 - DNA, 22 bp, Homo sapiens
cgcctggaacctctaggaccag

SEQ ID NO: 10049601 - DNA, 22 bp, Homo sapiens
cgcctgctctgtttccatgtgg

SEQ ID NO: 10049602 - DNA, 22 bp, Homo sapiens
cctttatactaaggcatacaat

SEQ ID NO: 10049603 - DNA, 22 bp, Homo sapiens
cgtggcagtggaaggctgggtg

SEQ ID NO: 10049604 - DNA, 22 bp, Homo sapiens
ctaaacaggaaggagcacctga

SEQ ID NO: 10049605 - DNA, 22 bp, Homo sapiens
ctaaacaatgaacaaagcactg

SEQ ID NO: 10049606 - DNA, 22 bp, Homo sapiens
ctaaacaatgaacaaagcactg

SEQ ID NO: 10049607 - DNA, 22 bp, Homo sapiens
cgtgcgcctcagcctcgtgcgc

SEQ ID NO: 10049608 - DNA, 22 bp, Homo sapiens
cgtgccactgcactctagcctg

SEQ ID NO: 10049609 - DNA, 22 bp, Homo sapiens
cgcctgggagtccacacctgct

SEQ ID NO: 10049610 - DNA, 22 bp, Homo sapiens
agtcactttatgagagaaccat

SEQ ID NO: 10049611 - DNA, 22 bp, Homo sapiens
agtcagagaatgttttcatgga

SEQ ID NO: 10049612 - DNA, 23 bp, Homo sapiens
agtcagagcagaagggctgcttg

SEQ ID NO: 10049613 - DNA, 22 bp, Homo sapiens
agtcagagttttgaggtgtgac

SEQ ID NO: 10049614 - DNA, 22 bp, Homo sapiens
ctacacagagcctacttctgca

SEQ ID NO: 10049615 - DNA, 22 bp, Homo sapiens
agtcagagtctattgctgtggt

SEQ ID NO: 10049616 - DNA, 17 bp, Homo sapiens
agtcagaggagtatctg

SEQ ID NO: 10049617 - DNA, 22 bp, Homo sapiens
agtcataaagccagtgggaggc

SEQ ID NO: 10049618 - DNA, 22 bp, Homo sapiens
agtcagttttctccagggggct

SEQ ID NO: 10049619 - DNA, 22 bp, Homo sapiens
agtcagttaacctcacagcatc

SEQ ID NO: 10049620 - DNA, 21 bp, Homo sapiens
ctacacagctttctataggaa

SEQ ID NO: 10049621 - DNA, 20 bp, Homo sapiens
ctacacagggttcgctgggc

SEQ ID NO: 10049622 - DNA, 22 bp, Homo sapiens
ctacacagttctgcctaatggc

SEQ ID NO: 10049623 - DNA, 22 bp, Homo sapiens
cctgggcaggccggacgctggg

SEQ ID NO: 10049624 - DNA, 23 bp, Homo sapiens
aggtgcactgtggtggcagtggc

SEQ ID NO: 10049625 - DNA, 22 bp, Homo sapiens
aggtctggtgttgggcctgaaa

SEQ ID NO: 10049626 - DNA, 22 bp, Homo sapiens
aggtctggtgagagcaggtgct

SEQ ID NO: 10049627 - DNA, 22 bp, Homo sapiens
aggtattattagcatctctatt

SEQ ID NO: 10049628 - DNA, 20 bp, Homo sapiens
aggtctgaatgtcagggctg

SEQ ID NO: 10049629 - DNA, 22 bp, Homo sapiens
aggtctgagtagagaaaaggca

SEQ ID NO: 10049630 - DNA, 22 bp, Homo sapiens
aggtctgagtatggcctgagaa

SEQ ID NO: 10049631 - DNA, 22 bp, Homo sapiens
aggtctgagctccttcctctga

SEQ ID NO: 10049632 - DNA, 22 bp, Homo sapiens
aggtctgagctcagggcctggc

SEQ ID NO: 10049633 - DNA, 22 bp, Homo sapiens
agggtggctggaggaatcagaa

SEQ ID NO: 10049634 - DNA, 21 bp, Homo sapiens
agggtggctctgggtcagaac

SEQ ID NO: 10049635 - DNA, 22 bp, Homo sapiens
cctgcctggctgtcagcagagc

SEQ ID NO: 10049636 - DNA, 22 bp, Homo sapiens
agggtggcaccacatatcatag

SEQ ID NO: 10049637 - DNA, 22 bp, Homo sapiens
agggtggcactggtggctctat

SEQ ID NO: 10049638 - DNA, 22 bp, Homo sapiens
cagtttcagaatcaaaacatca

SEQ ID NO: 10049639 - DNA, 23 bp, Homo sapiens
cagtggtcagaacgtgggagggt

SEQ ID NO: 10049640 - DNA, 22 bp, Homo sapiens
cagtggtactctcagatgttta

SEQ ID NO: 10049641 - DNA, 22 bp, Homo sapiens
cagtggctcatgcctataatcc

SEQ ID NO: 10049642 - DNA, 22 bp, Homo sapiens
cagtggcgtgatctctgctcac

SEQ ID NO: 10049643 - DNA, 22 bp, Homo sapiens
catagttttaggtagaaactgg

SEQ ID NO: 10049644 - DNA, 22 bp, Homo sapiens
catatttatagatctggcattt

SEQ ID NO: 10049645 - DNA, 22 bp, Homo sapiens
catatttattcttctgccagtg

SEQ ID NO: 10049646 - DNA, 22 bp, Homo sapiens
aggacccaagcacagttcctgg

SEQ ID NO: 10049647 - DNA, 22 bp, Homo sapiens
aggaccagcctccaggtctctt

SEQ ID NO: 10049648 - DNA, 22 bp, Homo sapiens
caggtgggagcggagactgatt

SEQ ID NO: 10049649 - DNA, 22 bp, Homo sapiens
caggtgggagcgaggagctact

SEQ ID NO: 10049650 - DNA, 22 bp, Homo sapiens
caggtgggagccacagcgtaca

SEQ ID NO: 10049651 - DNA, 22 bp, Homo sapiens
caggtggcttctctgcagcctt

SEQ ID NO: 10049652 - DNA, 22 bp, Homo sapiens
caggtgggaccatgatagggca

SEQ ID NO: 10049653 - DNA, 22 bp, Homo sapiens
aggagaaggaagtgcatcacta

SEQ ID NO: 10049654 - DNA, 22 bp, Homo sapiens
aggagaagtaaggctagatgat

SEQ ID NO: 10049655 - DNA, 19 bp, Homo sapiens
aggagaagtagcagaaatt

SEQ ID NO: 10049656 - DNA, 22 bp, Homo sapiens
aggactaaggaacagctgattc

SEQ ID NO: 10049657 - DNA, 22 bp, Homo sapiens
cagtgcctcaggccagcctgca

SEQ ID NO: 10049658 - DNA, 22 bp, Homo sapiens
cagtgcctcttaagtgtcaccc

SEQ ID NO: 10049659 - DNA, 21 bp, Homo sapiens
cagtgctcaggaatagagaga

SEQ ID NO: 10049660 - DNA, 22 bp, Homo sapiens
aggattgtgcctccagtcagaa

SEQ ID NO: 10049661 - DNA, 22 bp, Homo sapiens
catgctaaaccagaacatagga

SEQ ID NO: 10049662 - DNA, 21 bp, Homo sapiens
aggagggcacaaggccaggaa

SEQ ID NO: 10049663 - DNA, 22 bp, Homo sapiens
aggagggcaggctggctgccta

SEQ ID NO: 10049664 - DNA, 20 bp, Homo sapiens
aggaggggatagaatcaaag

SEQ ID NO: 10049665 - DNA, 16 bp, Homo sapiens
aggaggggaattagga

SEQ ID NO: 10049666 - DNA, 20 bp, Homo sapiens
aggaggggatagaatcaaag

SEQ ID NO: 10049667 - DNA, 22 bp, Homo sapiens
catgctaaaatatctgaagatt

SEQ ID NO: 10049668 - DNA, 18 bp, Homo sapiens
catgggtgacaggtggat

SEQ ID NO: 10049669 - DNA, 22 bp, Homo sapiens
catgtatagttggaactacatc

SEQ ID NO: 10049670 - DNA, 22 bp, Homo sapiens
catgtcaagcttatctctgtgg

SEQ ID NO: 10049671 - DNA, 22 bp, Homo sapiens
aggcactgcagattacaggcgc

SEQ ID NO: 10049672 - DNA, 22 bp, Homo sapiens
catgtcaataaatataactgca

SEQ ID NO: 10049673 - DNA, 22 bp, Homo sapiens
catggctgaacactcagtgact

SEQ ID NO: 10049674 - DNA, 22 bp, Homo sapiens
ccaagtcctgctgccactctac

SEQ ID NO: 10049675 - DNA, 18 bp, Homo sapiens
aggcaggctggagtgact

SEQ ID NO: 10049676 - DNA, 22 bp, Homo sapiens
ccaagcaggatattctgtgtca

SEQ ID NO: 10049677 - DNA, 22 bp, Homo sapiens
ccaagcaggatattctgtgtca

SEQ ID NO: 10049678 - DNA, 22 bp, Homo sapiens
ccaagcctagtcgtgcacacag

SEQ ID NO: 10049679 - DNA, 23 bp, Homo sapiens
aggcagcaggttgtccagggtga

SEQ ID NO: 10049680 - DNA, 22 bp, Homo sapiens
ccaaaggccaagctcaggtaaa

SEQ ID NO: 10049681 - DNA, 22 bp, Homo sapiens
ccaaaggccaggcactgaggtt

SEQ ID NO: 10049682 - DNA, 21 bp, Homo sapiens
ccaaaggctatgtatcttctg

SEQ ID NO: 10049683 - DNA, 22 bp, Homo sapiens
ccaaaggcggaactgagtctct

SEQ ID NO: 10049684 - DNA, 22 bp, Homo sapiens
aggcactgtgcagtcccaagca

SEQ ID NO: 10049685 - DNA, 22 bp, Homo sapiens
agctgattccactttttcccca

SEQ ID NO: 10049686 - DNA, 19 bp, Homo sapiens
agctgcagaccagaagtgc

SEQ ID NO: 10049687 - DNA, 19 bp, Homo sapiens
agctgcagaccagaagtgc

SEQ ID NO: 10049688 - DNA, 22 bp, Homo sapiens
agctgcagtgaactgttttgtc

SEQ ID NO: 10049689 - DNA, 22 bp, Homo sapiens
agctgcagttcgttccagctct

SEQ ID NO: 10049690 - DNA, 22 bp, Homo sapiens
agctgcagtgaactgttttgtc

SEQ ID NO: 10049691 - DNA, 22 bp, Homo sapiens
agctgccacagagcctggccag

SEQ ID NO: 10049692 - DNA, 22 bp, Homo sapiens
caggaggagcattagcgtctca

SEQ ID NO: 10049693 - DNA, 22 bp, Homo sapiens
agctgctgagccatgtcctgct

SEQ ID NO: 10049694 - DNA, 22 bp, Homo sapiens
caggcactggccagtcagcaca

SEQ ID NO: 10049695 - DNA, 22 bp, Homo sapiens
agctgctgcgcctcaccctggc

SEQ ID NO: 10049696 - DNA, 22 bp, Homo sapiens
agctgctgcctcactggtctgt

SEQ ID NO: 10049697 - DNA, 22 bp, Homo sapiens
caggccagcttcctgacatcct

SEQ ID NO: 10049698 - DNA, 22 bp, Homo sapiens
caggccagggagaatatgaagc

SEQ ID NO: 10049699 - DNA, 22 bp, Homo sapiens
caggccagggagaatatgaagc

SEQ ID NO: 10049700 - DNA, 19 bp, Homo sapiens
agctgggctgtcacagtga

SEQ ID NO: 10049701 - DNA, 19 bp, Homo sapiens
agctgggcttactcactcg

SEQ ID NO: 10049702 - DNA, 22 bp, Homo sapiens
caggctggagtgcagtgtcgcc

SEQ ID NO: 10049703 - DNA, 22 bp, Homo sapiens
caggctgctgtccacaaagcat

SEQ ID NO: 10049704 - DNA, 22 bp, Homo sapiens
caggctggagtgcagtggtgcc

SEQ ID NO: 10049705 - DNA, 22 bp, Homo sapiens
caggctggagtgcagtggtgcc

SEQ ID NO: 10049706 - DNA, 22 bp, Homo sapiens
cagggatgggatggagtcagtt

SEQ ID NO: 10049707 - DNA, 22 bp, Homo sapiens
cagggatgggatggagtcagtt

SEQ ID NO: 10049708 - DNA, 22 bp, Homo sapiens
caggctcagtcagaaaatgtat

SEQ ID NO: 10049709 - DNA, 22 bp, Homo sapiens
agctgtgattatccactggaat

SEQ ID NO: 10049710 - DNA, 22 bp, Homo sapiens
agctgtgctgtggtcatctggg

SEQ ID NO: 10049711 - DNA, 22 bp, Homo sapiens
caggggctgtgggcggagcctc

SEQ ID NO: 10049712 - DNA, 22 bp, Homo sapiens
caggtcctttagtgtccagaac

SEQ ID NO: 10049713 - DNA, 22 bp, Homo sapiens
caggtcctggcatcaggcaggt

SEQ ID NO: 10049714 - DNA, 22 bp, Homo sapiens
cagggatgtctctggaagggag

SEQ ID NO: 10049715 - DNA, 22 bp, Homo sapiens
cctcctggaaaaattccctggc

SEQ ID NO: 10049716 - DNA, 22 bp, Homo sapiens
cctcctgcggcgtccgcgctct

SEQ ID NO: 10049717 - DNA, 22 bp, Homo sapiens
cctcctgcacttgctttccttc

SEQ ID NO: 10049718 - DNA, 22 bp, Homo sapiens
cctcctgcactgcaagcttgag

SEQ ID NO: 10049719 - DNA, 22 bp, Homo sapiens
cctcctgcacctccaggaactc

SEQ ID NO: 10049720 - DNA, 22 bp, Homo sapiens
cctctggcttactgttgggttt

SEQ ID NO: 10049721 - DNA, 22 bp, Homo sapiens
aggggaccaaaatgtcctgcct

SEQ ID NO: 10049722 - DNA, 22 bp, Homo sapiens
aggggctggagttcgaggttac

SEQ ID NO: 10049723 - DNA, 22 bp, Homo sapiens
aggggctgggacagagccaagc

SEQ ID NO: 10049724 - DNA, 22 bp, Homo sapiens
ccctttccatggctctcctagg

SEQ ID NO: 10049725 - DNA, 22 bp, Homo sapiens
cccttcagtgctaggctgcctg

SEQ ID NO: 10049726 - DNA, 22 bp, Homo sapiens
cccttcagtgctaggctgcctg

SEQ ID NO: 10049727 - DNA, 22 bp, Homo sapiens
cccttcagtgcgtgagaatgag

SEQ ID NO: 10049728 - DNA, 22 bp, Homo sapiens
agggctccaggggaccatcagt

SEQ ID NO: 10049729 - DNA, 22 bp, Homo sapiens
agggctccgggccaccggcctg

SEQ ID NO: 10049730 - DNA, 22 bp, Homo sapiens
ccctctcttagaagaaacacag

SEQ ID NO: 10049731 - DNA, 22 bp, Homo sapiens
agggatggcaagttaacctgag

SEQ ID NO: 10049732 - DNA, 22 bp, Homo sapiens
agggatggatcttggccctgga

SEQ ID NO: 10049733 - DNA, 17 bp, Homo sapiens
agggagtcagtaggagc

SEQ ID NO: 10049734 - DNA, 22 bp, Homo sapiens
agggagaagagaacaaagccct

SEQ ID NO: 10049735 - DNA, 22 bp, Homo sapiens
agggatggagcccagctgttct

SEQ ID NO: 10049736 - DNA, 22 bp, Homo sapiens
aggctggctgacttctgaagca

SEQ ID NO: 10049737 - DNA, 22 bp, Homo sapiens
cccagagatgtcctgagtgata

SEQ ID NO: 10049738 - DNA, 19 bp, Homo sapiens
cccagagcatcctgaactt

SEQ ID NO: 10049739 - DNA, 22 bp, Homo sapiens
cccagagccgctcccctacttc

SEQ ID NO: 10049740 - DNA, 22 bp, Homo sapiens
cccagagcatgtgctgcctttg

SEQ ID NO: 10049741 - DNA, 21 bp, Homo sapiens
cccagagcctagggagggcac

SEQ ID NO: 10049742 - DNA, 22 bp, Homo sapiens
aggctctgtcaggcggagcagc

SEQ ID NO: 10049743 - DNA, 22 bp, Homo sapiens
aggctctgtgcatcctccccaa

SEQ ID NO: 10049744 - DNA, 22 bp, Homo sapiens
aggctccaccctacagagctcc

SEQ ID NO: 10049745 - DNA, 22 bp, Homo sapiens
aggctccaccccgccagacctt

SEQ ID NO: 10049746 - DNA, 22 bp, Homo sapiens
aggctccaccagtcaggtgcat

SEQ ID NO: 10049747 - DNA, 22 bp, Homo sapiens
aggctccaaattaccaagctct

SEQ ID NO: 10049748 - DNA, 16 bp, Homo sapiens
aggctccaagagctgt

SEQ ID NO: 10049749 - DNA, 22 bp, Homo sapiens
aggctccaagaggttaagtcac

SEQ ID NO: 10049750 - DNA, 23 bp, Homo sapiens
aggctccacatgggcactttgca

SEQ ID NO: 10049751 - DNA, 19 bp, Homo sapiens
ccagcagaagccactcctg

SEQ ID NO: 10049752 - DNA, 22 bp, Homo sapiens
ccagcagagctggaagtgtgct

SEQ ID NO: 10049753 - DNA, 19 bp, Homo sapiens
ccagcagacacagctgccc

SEQ ID NO: 10049754 - DNA, 22 bp, Homo sapiens
ccagcagagcatggggaggaag

SEQ ID NO: 10049755 - DNA, 22 bp, Homo sapiens
ccagcagaggcatcatccttcc

SEQ ID NO: 10049756 - DNA, 22 bp, Homo sapiens
ccagagtgacgtgaagtgtgaa

SEQ ID NO: 10049757 - DNA, 22 bp, Homo sapiens
ccagagcagatgtggccttggt

SEQ ID NO: 10049758 - DNA, 22 bp, Homo sapiens
ccagagagggcgccacctggag

SEQ ID NO: 10049759 - DNA, 20 bp, Homo sapiens
ccagagagtaggttagtgat

SEQ ID NO: 10049760 - DNA, 22 bp, Homo sapiens
ccagagaggtagcttaccctct

SEQ ID NO: 10049761 - DNA, 22 bp, Homo sapiens
ccagagaggggaagggcttgcc

SEQ ID NO: 10049762 - DNA, 22 bp, Homo sapiens
ccagagagtatcatggagagta

SEQ ID NO: 10049763 - DNA, 22 bp, Homo sapiens
ccagagagtcgatgggggacac

SEQ ID NO: 10049764 - DNA, 22 bp, Homo sapiens
aggcagggtcttgctatgttgc

SEQ ID NO: 10049765 - DNA, 22 bp, Homo sapiens
aggcagggtgatgataatgatt

SEQ ID NO: 10049766 - DNA, 22 bp, Homo sapiens
ccacagcttcgcagtctgctgc

SEQ ID NO: 10049767 - DNA, 22 bp, Homo sapiens
aggcccagagcaggaaagggtt

SEQ ID NO: 10049768 - DNA, 22 bp, Homo sapiens
ccagcctcatcgcctgcctgtc

SEQ ID NO: 10049769 - DNA, 22 bp, Homo sapiens
ccagcctcatcgcctgcctgtc

SEQ ID NO: 10049770 - DNA, 23 bp, Homo sapiens
ccagcctctgggtcttcatccag

SEQ ID NO: 10049771 - DNA, 23 bp, Homo sapiens
ccagcctctgggtcttcatccag

SEQ ID NO: 10049772 - DNA, 22 bp, Homo sapiens
ccaggacaagtgtggccatggc

SEQ ID NO: 10049773 - DNA, 22 bp, Homo sapiens
ccaggacaattcgtcactttct

SEQ ID NO: 10049774 - DNA, 22 bp, Homo sapiens
ccaggagagcattgcacagagg

SEQ ID NO: 10049775 - DNA, 22 bp, Homo sapiens
ccaggagagcagaagcccaggc

SEQ ID NO: 10049776 - DNA, 22 bp, Homo sapiens
ggtatgaattcactacttccaa

SEQ ID NO: 10049777 - DNA, 20 bp, Homo sapiens
gggtgtggcctgggaatttg

SEQ ID NO: 10049778 - DNA, 21 bp, Homo sapiens
gggtgtggaaattacatcctg

SEQ ID NO: 10049779 - DNA, 22 bp, Homo sapiens
gggtgtggctgcgtgccaataa

SEQ ID NO: 10049780 - DNA, 22 bp, Homo sapiens
gggttaaacatgctatatgagt

SEQ ID NO: 10049781 - DNA, 22 bp, Homo sapiens
gggtgtgtgcagggtggcactc

SEQ ID NO: 10049782 - DNA, 23 bp, Homo sapiens
cagatgaggttggcagcatggtc

SEQ ID NO: 10049783 - DNA, 22 bp, Homo sapiens
cagatgcagcaaaatgacaggc

SEQ ID NO: 10049784 - DNA, 19 bp, Homo sapiens
cagatgttttcagttcatt

SEQ ID NO: 10049785 - DNA, 22 bp, Homo sapiens
ggtcctgcgtctggctcgcccg

SEQ ID NO: 10049786 - DNA, 22 bp, Homo sapiens
ggtcaacactgtgaccaacagg

SEQ ID NO: 10049787 - DNA, 22 bp, Homo sapiens
ggtatttatatgtctgaagctg

SEQ ID NO: 10049788 - DNA, 22 bp, Homo sapiens
ggggccttttctgaatgtggaa

SEQ ID NO: 10049789 - DNA, 22 bp, Homo sapiens
ggggccttggatctgtgccccg

SEQ ID NO: 10049790 - DNA, 20 bp, Homo sapiens
ggggttggctggcacaggga

SEQ ID NO: 10049791 - DNA, 22 bp, Homo sapiens
gggtaagctgctttatctctct

SEQ ID NO: 10049792 - DNA, 22 bp, Homo sapiens
cagagcagaagcggtcctcaca

SEQ ID NO: 10049793 - DNA, 22 bp, Homo sapiens
cagagcagaaggtccaagcctg

SEQ ID NO: 10049794 - DNA, 20 bp, Homo sapiens
cagagcagtgcccaggcggc

SEQ ID NO: 10049795 - DNA, 22 bp, Homo sapiens
cagagcagtggggttggtcaga

SEQ ID NO: 10049796 - DNA, 22 bp, Homo sapiens
cagagccactgcattttacagc

SEQ ID NO: 10049797 - DNA, 20 bp, Homo sapiens
cagagccaagagcagcatct

SEQ ID NO: 10049798 - DNA, 22 bp, Homo sapiens
cagagcagaaacctgggtgatt

SEQ ID NO: 10049799 - DNA, 22 bp, Homo sapiens
cagagacaatgtctctgcttgt

SEQ ID NO: 10049800 - DNA, 22 bp, Homo sapiens
cagagacaccccagaaaataag

SEQ ID NO: 10049801 - DNA, 22 bp, Homo sapiens
cagagacaacaagtttaactat

SEQ ID NO: 10049802 - DNA, 22 bp, Homo sapiens
gggaggcagtgctggaggctgg

SEQ ID NO: 10049803 - DNA, 22 bp, Homo sapiens
gggagctgccaccacccctggg

SEQ ID NO: 10049804 - DNA, 22 bp, Homo sapiens
gggagctgccttagaccggagg

SEQ ID NO: 10049805 - DNA, 22 bp, Homo sapiens
gggagctgctgaacacaagggt

SEQ ID NO: 10049806 - DNA, 22 bp, Homo sapiens
cagacacagatatgcatatggc

SEQ ID NO: 10049807 - DNA, 22 bp, Homo sapiens
cagacacaccaggcccattctg

SEQ ID NO: 10049808 - DNA, 22 bp, Homo sapiens
cagacagaaggaaggccaacat

SEQ ID NO: 10049809 - DNA, 22 bp, Homo sapiens
cagacaaccaggtctttcagtt

SEQ ID NO: 10049810 - DNA, 22 bp, Homo sapiens
gtcacaggaaagggtgtaaggg

SEQ ID NO: 10049811 - DNA, 22 bp, Homo sapiens
gtcacaggcagtaactaggacc

SEQ ID NO: 10049812 - DNA, 22 bp, Homo sapiens
gtcacaggcctggatgaggggc

SEQ ID NO: 10049813 - DNA, 22 bp, Homo sapiens
gtcacaggaagcagcaggcact

SEQ ID NO: 10049814 - DNA, 22 bp, Homo sapiens
gtcacagggtccccatatggag

SEQ ID NO: 10049815 - DNA, 22 bp, Homo sapiens
gtccagagtagtcgagtattct

SEQ ID NO: 10049816 - DNA, 22 bp, Homo sapiens
cagccaggagctccccctgctc

SEQ ID NO: 10049817 - DNA, 22 bp, Homo sapiens
cagccaggagcctctgcaacta

SEQ ID NO: 10049818 - DNA, 19 bp, Homo sapiens
cagcatctgagccgtgtcc

SEQ ID NO: 10049819 - DNA, 22 bp, Homo sapiens
gtccagagggctgcaggatgct

SEQ ID NO: 10049820 - DNA, 22 bp, Homo sapiens
gtccagaggtccaggatcaagg

SEQ ID NO: 10049821 - DNA, 22 bp, Homo sapiens
gtagaaaaagcagtaagtctca

SEQ ID NO: 10049822 - DNA, 22 bp, Homo sapiens
gtagaaaattaggatgaggctt

SEQ ID NO: 10049823 - DNA, 22 bp, Homo sapiens
cagcagcctagaagctctacca

SEQ ID NO: 10049824 - DNA, 22 bp, Homo sapiens
gtacacagagtggtggaagaaa

SEQ ID NO: 10049825 - DNA, 22 bp, Homo sapiens
gtacacagatgcttgagaatct

SEQ ID NO: 10049826 - DNA, 22 bp, Homo sapiens
gtacacaggcagcccagtgctg

SEQ ID NO: 10049827 - DNA, 20 bp, Homo sapiens
gtactcagatcaagtcagct

SEQ ID NO: 10049828 - DNA, 19 bp, Homo sapiens
cagcagccagggggcccct

SEQ ID NO: 10049829 - DNA, 22 bp, Homo sapiens
cagcagccactagagggctcac

SEQ ID NO: 10049830 - DNA, 20 bp, Homo sapiens
cagcagccattctagtagta

SEQ ID NO: 10049831 - DNA, 22 bp, Homo sapiens
cagcagcctacaatgcacagaa

SEQ ID NO: 10049832 - DNA, 22 bp, Homo sapiens
cagcagccgagagggggctctg

SEQ ID NO: 10049833 - DNA, 22 bp, Homo sapiens
cagcagccctttggctgaactg

SEQ ID NO: 10049834 - DNA, 22 bp, Homo sapiens
cagcagcccacgcgtgctgtcc

SEQ ID NO: 10049835 - DNA, 22 bp, Homo sapiens
cagcagcagattcagcgtctgg

SEQ ID NO: 10049836 - DNA, 22 bp, Homo sapiens
cagatttaagagataaacagtg

SEQ ID NO: 10049837 - DNA, 20 bp, Homo sapiens
cagcaaaatgaaaatggatt

SEQ ID NO: 10049838 - DNA, 23 bp, Homo sapiens
gtgagcagcaccatgaggctaga

SEQ ID NO: 10049839 - DNA, 22 bp, Homo sapiens
cagccctgtccaatgtctgctc

SEQ ID NO: 10049840 - DNA, 22 bp, Homo sapiens
cagccctgtccctgagggacct

SEQ ID NO: 10049841 - DNA, 22 bp, Homo sapiens
cacaaagttggacaacgcaccc

SEQ ID NO: 10049842 - DNA, 22 bp, Homo sapiens
cacaaatggccgtgttcaaaga

SEQ ID NO: 10049843 - DNA, 22 bp, Homo sapiens
cacaaatgtgcagaaatgtgag

SEQ ID NO: 10049844 - DNA, 22 bp, Homo sapiens
cacaaatgtagtagcttaaaac

SEQ ID NO: 10049845 - DNA, 22 bp, Homo sapiens
cacaactgccatctgagcagca

SEQ ID NO: 10049846 - DNA, 22 bp, Homo sapiens
cacacaggagagtgctggaggt

SEQ ID NO: 10049847 - DNA, 22 bp, Homo sapiens
cacacaggatgaagcagcagaa

SEQ ID NO: 10049848 - DNA, 22 bp, Homo sapiens
ggagaaggcacacccacctctg

SEQ ID NO: 10049849 - DNA, 22 bp, Homo sapiens
cacacaggtatatatatgtaca

SEQ ID NO: 10049850 - DNA, 22 bp, Homo sapiens
ggagaagggtatgtgtggcgga

SEQ ID NO: 10049851 - DNA, 22 bp, Homo sapiens
ggagaagggacagactcagctt

SEQ ID NO: 10049852 - DNA, 22 bp, Homo sapiens
ggagagaggagcccactgctgt

SEQ ID NO: 10049853 - DNA, 22 bp, Homo sapiens
caatttcaagattctgttcttt

SEQ ID NO: 10049854 - DNA, 19 bp, Homo sapiens
caatatatagtgagtggat

SEQ ID NO: 10049855 - DNA, 22 bp, Homo sapiens
caatttcatcttgtgcttcaat

SEQ ID NO: 10049856 - DNA, 22 bp, Homo sapiens
gctggggagctagacctcagca

SEQ ID NO: 10049857 - DNA, 21 bp, Homo sapiens
gctgccctggctcagcattca

SEQ ID NO: 10049858 - DNA, 22 bp, Homo sapiens
caaagtgagagaatggcagaaa

SEQ ID NO: 10049859 - DNA, 22 bp, Homo sapiens
caaagtgctaggattacaggcc

SEQ ID NO: 10049860 - DNA, 22 bp, Homo sapiens
caaagtgctaggattacaggcg

SEQ ID NO: 10049861 - DNA, 22 bp, Homo sapiens
caaagtcctagaacagtgcttg

SEQ ID NO: 10049862 - DNA, 22 bp, Homo sapiens
caacacaggttctgcaaaggaa

SEQ ID NO: 10049863 - DNA, 22 bp, Homo sapiens
caacaatttcccagtttcccat

SEQ ID NO: 10049864 - DNA, 22 bp, Homo sapiens
caacaatatgctgagtttttca

SEQ ID NO: 10049865 - DNA, 22 bp, Homo sapiens
caacaacatgggattcatttct

SEQ ID NO: 10049866 - DNA, 22 bp, Homo sapiens
caacaatatgccagactcaatt

SEQ ID NO: 10049867 - DNA, 22 bp, Homo sapiens
gctgccctgtccggctctcctg

SEQ ID NO: 10049868 - DNA, 22 bp, Homo sapiens
caaattttgtgtgttctctagt

SEQ ID NO: 10049869 - DNA, 22 bp, Homo sapiens
caagaacagtttgccaaattgg

SEQ ID NO: 10049870 - DNA, 22 bp, Homo sapiens
caagaaccgcaattacttttgc

SEQ ID NO: 10049871 - DNA, 22 bp, Homo sapiens
gctgcctgatgtccagcaggac

SEQ ID NO: 10049872 - DNA, 22 bp, Homo sapiens
caagctctgcgggctccaagat

SEQ ID NO: 10049873 - DNA, 22 bp, Homo sapiens
gctggggactccccaccatagc

SEQ ID NO: 10049874 - DNA, 22 bp, Homo sapiens
gctggcccagcgtggggccgtg

SEQ ID NO: 10049875 - DNA, 17 bp, Homo sapiens
gctggctgacccatgcc

SEQ ID NO: 10049876 - DNA, 22 bp, Homo sapiens
gctggctgagcactggtttata

SEQ ID NO: 10049877 - DNA, 22 bp, Homo sapiens
gctggctgaggtctagctcttt

SEQ ID NO: 10049878 - DNA, 22 bp, Homo sapiens
caagaattaagaattttgatgt

SEQ ID NO: 10049879 - DNA, 22 bp, Homo sapiens
gctgcctgcacagagctgcttt

SEQ ID NO: 10049880 - DNA, 22 bp, Homo sapiens
gctgcctgccctgggtcatctg

SEQ ID NO: 10049881 - DNA, 22 bp, Homo sapiens
gctgctttgtctgtaaaatgga

SEQ ID NO: 10049882 - DNA, 22 bp, Homo sapiens
cactctaacctccatcttccat

SEQ ID NO: 10049883 - DNA, 20 bp, Homo sapiens
cactctaaccatatttcctc

SEQ ID NO: 10049884 - DNA, 21 bp, Homo sapiens
cactccacttagaacagggtt

SEQ ID NO: 10049885 - DNA, 22 bp, Homo sapiens
cactccagcctcagtgacagag

SEQ ID NO: 10049886 - DNA, 22 bp, Homo sapiens
cactcagaggtttgattgctca

SEQ ID NO: 10049887 - DNA, 22 bp, Homo sapiens
cactagtcctggtttcatgcta

SEQ ID NO: 10049888 - DNA, 20 bp, Homo sapiens
caccaggcgctctgagaaca

SEQ ID NO: 10049889 - DNA, 22 bp, Homo sapiens
caccaggctgaaccagagggga

SEQ ID NO: 10049890 - DNA, 22 bp, Homo sapiens
caccaggctgagcctctcatct

SEQ ID NO: 10049891 - DNA, 22 bp, Homo sapiens
cacctgcctgctagagcctgac

SEQ ID NO: 10049892 - DNA, 22 bp, Homo sapiens
cacctgcctgcaggggctccac

SEQ ID NO: 10049893 - DNA, 22 bp, Homo sapiens
cacctgcctcatttgtccctgc

SEQ ID NO: 10049894 - DNA, 22 bp, Homo sapiens
ggccaggctggtctcagacttc

SEQ ID NO: 10049895 - DNA, 22 bp, Homo sapiens
cacctggagtagcaaggtaatt

SEQ ID NO: 10049896 - DNA, 22 bp, Homo sapiens
cactgcactccagcctgggtca

SEQ ID NO: 10049897 - DNA, 22 bp, Homo sapiens
cactgcactccagcctgggtga

SEQ ID NO: 10049898 - DNA, 22 bp, Homo sapiens
cactgcactccagcttgggtga

SEQ ID NO: 10049899 - DNA, 22 bp, Homo sapiens
cactggtgtctgagcagggtga

SEQ ID NO: 10049900 - DNA, 22 bp, Homo sapiens
cactgtacagcattaacaaggc

SEQ ID NO: 10049901 - DNA, 22 bp, Homo sapiens
cactgtacccatttaaataaat

SEQ ID NO: 10049902 - DNA, 22 bp, Homo sapiens
cactgtactgggttgaaggacg

SEQ ID NO: 10049903 - DNA, 22 bp, Homo sapiens
cactgtaatagcattataagtg

SEQ ID NO: 10049904 - DNA, 22 bp, Homo sapiens
cactgtactgtgaataaggagg

SEQ ID NO: 10049905 - DNA, 22 bp, Homo sapiens
ggctctgcttcagaaggctcat

SEQ ID NO: 10049906 - DNA, 21 bp, Homo sapiens
cactttaaaaatatctttata

SEQ ID NO: 10049907 - DNA, 22 bp, Homo sapiens
cactttaaaactgacagccctt

SEQ ID NO: 10049908 - DNA, 22 bp, Homo sapiens
ggcaatcattggcattctctgg

SEQ ID NO: 10049909 - DNA, 22 bp, Homo sapiens
cacatgagagcccccaagagca

SEQ ID NO: 10049910 - DNA, 22 bp, Homo sapiens
cacatgactctggctacccaga

SEQ ID NO: 10049911 - DNA, 19 bp, Homo sapiens
cacatgagggctgagggac

SEQ ID NO: 10049912 - DNA, 22 bp, Homo sapiens
cacatgctccatacagaatggg

SEQ ID NO: 10049913 - DNA, 22 bp, Homo sapiens
ggcagagttggtggagtcagtt

SEQ ID NO: 10049914 - DNA, 22 bp, Homo sapiens
ggcagagtggagtgcggcctcc

SEQ ID NO: 10049915 - DNA, 22 bp, Homo sapiens
cacattaagaataatgagacta

SEQ ID NO: 10049916 - DNA, 20 bp, Homo sapiens
cacattaaggaaaacaactg

SEQ ID NO: 10049917 - DNA, 22 bp, Homo sapiens
cacattaaaatcctaacttcca

SEQ ID NO: 10049918 - DNA, 22 bp, Homo sapiens
cacattaaaatcctaacttcca

SEQ ID NO: 10049919 - DNA, 22 bp, Homo sapiens
cacatgttcttaacttctgttt

SEQ ID NO: 10049920 - DNA, 22 bp, Homo sapiens
cacatgtgtatatgtgaggggg

SEQ ID NO: 10049921 - DNA, 22 bp, Homo sapiens
caccagctttgcccactgccca

SEQ ID NO: 10049922 - DNA, 22 bp, Homo sapiens
caccaggagcatctaggaggcg

SEQ ID NO: 10049923 - DNA, 22 bp, Homo sapiens
cacaggcaggaggttctccagt

SEQ ID NO: 10049924 - DNA, 23 bp, Homo sapiens
cacaggcagaaatcaagacggta

SEQ ID NO: 10049925 - DNA, 22 bp, Homo sapiens
cacaggcacgcctctggccagg

SEQ ID NO: 10049926 - DNA, 22 bp, Homo sapiens
cacaggggcaaactgtagggga

SEQ ID NO: 10049927 - DNA, 22 bp, Homo sapiens
cacaggtgccatctcttcatgg

SEQ ID NO: 10049928 - DNA, 22 bp, Homo sapiens
cacaggtccttcctgccctggg

SEQ ID NO: 10049929 - DNA, 20 bp, Homo sapiens
cacaggccttgtgagcagac

SEQ ID NO: 10049930 - DNA, 20 bp, Homo sapiens
cacaggccttgtgagcagac

SEQ ID NO: 10049931 - DNA, 22 bp, Homo sapiens
cacaggccagtaagactgtgtt

SEQ ID NO: 10049932 - DNA, 22 bp, Homo sapiens
cacagtcctgccagagggcctt

SEQ ID NO: 10049933 - DNA, 22 bp, Homo sapiens
cacaggtgtttgttatactcag

SEQ ID NO: 10049934 - DNA, 23 bp, Homo sapiens
cacaggtgtttcatcttctcagt

SEQ ID NO: 10049935 - DNA, 22 bp, Homo sapiens
cacaggtgtgtgccttatcaaa

SEQ ID NO: 10049936 - DNA, 22 bp, Homo sapiens
cacaggtggcttctttcatctt

SEQ ID NO: 10049937 - DNA, 22 bp, Homo sapiens
attatatttgaaaggttggaag

SEQ ID NO: 10049938 - DNA, 22 bp, Homo sapiens
attatataggacttgcccttcc

SEQ ID NO: 10049939 - DNA, 22 bp, Homo sapiens
attatattgagtataaccagag

SEQ ID NO: 10049940 - DNA, 22 bp, Homo sapiens
gcaccagggtgctgtgttctgg

SEQ ID NO: 10049941 - DNA, 22 bp, Homo sapiens
gcaccagggagggtgtgcttca

SEQ ID NO: 10049942 - DNA, 22 bp, Homo sapiens
gcacacagattaggaaacagaa

SEQ ID NO: 10049943 - DNA, 22 bp, Homo sapiens
gcacacagactaaccatatttc

SEQ ID NO: 10049944 - DNA, 22 bp, Homo sapiens
gcagagatattgatatagattt

SEQ ID NO: 10049945 - DNA, 22 bp, Homo sapiens
gcagagactagtagtgcagact

SEQ ID NO: 10049946 - DNA, 22 bp, Homo sapiens
gcagagaggaatgaagccatcc

SEQ ID NO: 10049947 - DNA, 22 bp, Homo sapiens
gcagagaggatattattgtcca

SEQ ID NO: 10049948 - DNA, 22 bp, Homo sapiens
gcagagagttgggctgcgccag

SEQ ID NO: 10049949 - DNA, 22 bp, Homo sapiens
atgttatgtctgggaaggggta

SEQ ID NO: 10049950 - DNA, 22 bp, Homo sapiens
gagtggggaaagccaggacaga

SEQ ID NO: 10049951 - DNA, 23 bp, Homo sapiens
gagtggggagaaattggttaaac

SEQ ID NO: 10049952 - DNA, 23 bp, Homo sapiens
gagtggggagaaattggttaaac

SEQ ID NO: 10049953 - DNA, 22 bp, Homo sapiens
gagtggggaaagccaggacaga

SEQ ID NO: 10049954 - DNA, 22 bp, Homo sapiens
gattcttacttctaagcaagct

SEQ ID NO: 10049955 - DNA, 22 bp, Homo sapiens
gatgtctttagggcaaaatatt

SEQ ID NO: 10049956 - DNA, 22 bp, Homo sapiens
gatgtcttcagatggcaagaga

SEQ ID NO: 10049957 - DNA, 22 bp, Homo sapiens
gcagctgtgggttccaagtcta

SEQ ID NO: 10049958 - DNA, 19 bp, Homo sapiens
gcaggcagctggggtatcc

SEQ ID NO: 10049959 - DNA, 22 bp, Homo sapiens
gcaggcaggagcccaactgcct

SEQ ID NO: 10049960 - DNA, 22 bp, Homo sapiens
attccaaggtctttctagattg

SEQ ID NO: 10049961 - DNA, 22 bp, Homo sapiens
attccaaagcacatcagaacta

SEQ ID NO: 10049962 - DNA, 22 bp, Homo sapiens
attccaaagcctgaataatgga

SEQ ID NO: 10049963 - DNA, 22 bp, Homo sapiens
attccaaaggctggcctggagg

SEQ ID NO: 10049964 - DNA, 22 bp, Homo sapiens
attcacaaaatgatatagatac

SEQ ID NO: 10049965 - DNA, 22 bp, Homo sapiens
attccaaaaggatgttagaatg

SEQ ID NO: 10049966 - DNA, 19 bp, Homo sapiens
attcatttttgccttctaa

SEQ ID NO: 10049967 - DNA, 22 bp, Homo sapiens
attccaaagacagaagcagctg

SEQ ID NO: 10049968 - DNA, 22 bp, Homo sapiens
attccaaacagtgctgcagact

SEQ ID NO: 10049969 - DNA, 21 bp, Homo sapiens
attctttgatgtgcaataagt

SEQ ID NO: 10049970 - DNA, 19 bp, Homo sapiens
gcatcagagcagaaggggt

SEQ ID NO: 10049971 - DNA, 22 bp, Homo sapiens
gcatcagcaccaaccttccagg

SEQ ID NO: 10049972 - DNA, 19 bp, Homo sapiens
gcatcagagcagaaggggt

SEQ ID NO: 10049973 - DNA, 22 bp, Homo sapiens
gcatggcagaacacctcgcccg

SEQ ID NO: 10049974 - DNA, 22 bp, Homo sapiens
gcatggcaagatcaggagacca

SEQ ID NO: 10049975 - DNA, 22 bp, Homo sapiens
gcatgcttttatatctgtttaa

SEQ ID NO: 10049976 - DNA, 22 bp, Homo sapiens
gcagtaaaggtgacaatatagg

SEQ ID NO: 10049977 - DNA, 22 bp, Homo sapiens
atttgtatcttctaatattatc

SEQ ID NO: 10049978 - DNA, 22 bp, Homo sapiens
atttgtatcaatctcaatatat

SEQ ID NO: 10049979 - DNA, 22 bp, Homo sapiens
atttgtatatttaagagggtag

SEQ ID NO: 10049980 - DNA, 22 bp, Homo sapiens
atttcttccattgcctcttcaa

SEQ ID NO: 10049981 - DNA, 20 bp, Homo sapiens
gccttccagttcagtggcac

SEQ ID NO: 10049982 - DNA, 22 bp, Homo sapiens
gccttccacgtcaggggaaata

SEQ ID NO: 10049983 - DNA, 22 bp, Homo sapiens
gccttccagaatacacatagca

SEQ ID NO: 10049984 - DNA, 17 bp, Homo sapiens
gccttccagcatgtggg

SEQ ID NO: 10049985 - DNA, 20 bp, Homo sapiens
caaaagcaatgaagttatga

SEQ ID NO: 10049986 - DNA, 22 bp, Homo sapiens
caaagacacgggaaacaacgtt

SEQ ID NO: 10049987 - DNA, 22 bp, Homo sapiens
caaagaatcactcatctttagc

SEQ ID NO: 10049988 - DNA, 22 bp, Homo sapiens
caaagaagagatttacagagct

SEQ ID NO: 10049989 - DNA, 22 bp, Homo sapiens
caaagacacgggaaacaacgtt

SEQ ID NO: 10049990 - DNA, 20 bp, Homo sapiens
caaagacatgctaggggtgg

SEQ ID NO: 10049991 - DNA, 22 bp, Homo sapiens
atttagtttaggaaaagtaggt

SEQ ID NO: 10049992 - DNA, 22 bp, Homo sapiens
atttatattttgggagctcctg

SEQ ID NO: 10049993 - DNA, 22 bp, Homo sapiens
atttatctctggaaactaagca

SEQ ID NO: 10049994 - DNA, 22 bp, Homo sapiens
gccatcatatcccctgtgacct

SEQ ID NO: 10049995 - DNA, 22 bp, Homo sapiens
gccagccagagtggctgtgtgt

SEQ ID NO: 10049996 - DNA, 22 bp, Homo sapiens
gccagccacttcagctatggct

SEQ ID NO: 10049997 - DNA, 22 bp, Homo sapiens
gccagccagtttgctgatggct

SEQ ID NO: 10049998 - DNA, 22 bp, Homo sapiens
gccagccagtttgctgatggct

SEQ ID NO: 10049999 - DNA, 22 bp, Homo sapiens
attgtacatgcagtgagtcatc

SEQ ID NO: 10050000 - DNA, 22 bp, Homo sapiens
gccatgactctccataccaaag

SEQ ID NO: 10050001 - DNA, 22 bp, Homo sapiens
gccatcctggattcagaccaaa

SEQ ID NO: 10050002 - DNA, 22 bp, Homo sapiens
gcccaggtttcatctgctccgt

SEQ ID NO: 10050003 - DNA, 22 bp, Homo sapiens
atttcaaggctattaatataaa

SEQ ID NO: 10050004 - DNA, 22 bp, Homo sapiens
atttcaaggactacttttcaat

SEQ ID NO: 10050005 - DNA, 22 bp, Homo sapiens
gccctgggctccctgctccaca

SEQ ID NO: 10050006 - DNA, 22 bp, Homo sapiens
gccctggggaaggtgtctccaa

SEQ ID NO: 10050007 - DNA, 22 bp, Homo sapiens
gccctgtgccagtcacgctgtg

SEQ ID NO: 10050008 - DNA, 22 bp, Homo sapiens
gccctgtcccttggcttctagg

SEQ ID NO: 10050009 - DNA, 22 bp, Homo sapiens
atttcttcaggttcttctagga

SEQ ID NO: 10050010 - DNA, 22 bp, Homo sapiens
atttcttacataacaaattgtt

SEQ ID NO: 10050011 - DNA, 22 bp, Homo sapiens
atgtgctttgctggaaatgtca

SEQ ID NO: 10050012 - DNA, 22 bp, Homo sapiens
atgtgctttattaagtaaaaat

SEQ ID NO: 10050013 - DNA, 22 bp, Homo sapiens
atgtcactgtgaggcagctgtc

SEQ ID NO: 10050014 - DNA, 22 bp, Homo sapiens
atgtcacttttctccctgctgg

SEQ ID NO: 10050015 - DNA, 22 bp, Homo sapiens
atgttatagttataaaatgagg

SEQ ID NO: 10050016 - DNA, 22 bp, Homo sapiens
atgttaaaaaccagtacagttg

SEQ ID NO: 10050017 - DNA, 22 bp, Homo sapiens
atgtatttctatgtagtgaaga

SEQ ID NO: 10050018 - DNA, 22 bp, Homo sapiens
gagccccaccctagacattctg

SEQ ID NO: 10050019 - DNA, 22 bp, Homo sapiens
gagccccaggacagctctagtt

SEQ ID NO: 10050020 - DNA, 22 bp, Homo sapiens
gagctgcagacatagataagcg

SEQ ID NO: 10050021 - DNA, 22 bp, Homo sapiens
gagctgcagacttgatacagga

SEQ ID NO: 10050022 - DNA, 22 bp, Homo sapiens
atgggagaaacatcatgaggca

SEQ ID NO: 10050023 - DNA, 22 bp, Homo sapiens
atgggaggaagagaagatgtct

SEQ ID NO: 10050024 - DNA, 22 bp, Homo sapiens
atggcagacctgggctggagaa

SEQ ID NO: 10050025 - DNA, 22 bp, Homo sapiens
atggcagacgaggcagcagggg

SEQ ID NO: 10050026 - DNA, 22 bp, Homo sapiens
gagaagttgtgtggatttaaag

SEQ ID NO: 10050027 - DNA, 22 bp, Homo sapiens
gagaagtcatttgaccacctag

SEQ ID NO: 10050028 - DNA, 22 bp, Homo sapiens
gagaaggtggacctgaaggagc

SEQ ID NO: 10050029 - DNA, 22 bp, Homo sapiens
atgcttaactctgtacatagtt

SEQ ID NO: 10050030 - DNA, 22 bp, Homo sapiens
atggcagaaaggcatgtgggcc

SEQ ID NO: 10050031 - DNA, 22 bp, Homo sapiens
atggcagacacaggcaggcaga

SEQ ID NO: 10050032 - DNA, 22 bp, Homo sapiens
gagaatcatggcaacagaatga

SEQ ID NO: 10050033 - DNA, 22 bp, Homo sapiens
gagaatcatttacagaatgatt

SEQ ID NO: 10050034 - DNA, 22 bp, Homo sapiens
atgccactgcactccagcctag

SEQ ID NO: 10050035 - DNA, 22 bp, Homo sapiens
atgccactgcactccagcctgg

SEQ ID NO: 10050036 - DNA, 22 bp, Homo sapiens
gaagtagattcgttgcatcttg

SEQ ID NO: 10050037 - DNA, 22 bp, Homo sapiens
gaagtctgactctttgtaagct

SEQ ID NO: 10050038 - DNA, 22 bp, Homo sapiens
gaagtctgctgctcaggagttt

SEQ ID NO: 10050039 - DNA, 22 bp, Homo sapiens
gacagcttgcctggtactgcaa

SEQ ID NO: 10050040 - DNA, 22 bp, Homo sapiens
atgctcttgaggctaaagacat

SEQ ID NO: 10050041 - DNA, 22 bp, Homo sapiens
atgctgcctcctcttcagccgc

SEQ ID NO: 10050042 - DNA, 16 bp, Homo sapiens
atgctgctattagagg

SEQ ID NO: 10050043 - DNA, 22 bp, Homo sapiens
atgctaaattcagacagggtta

SEQ ID NO: 10050044 - DNA, 22 bp, Homo sapiens
atgctaaatgttaatgttacct

SEQ ID NO: 10050045 - DNA, 22 bp, Homo sapiens
atgctaatgtttgtggaagata

SEQ ID NO: 10050046 - DNA, 22 bp, Homo sapiens
atgctaattccatgagcacagg

SEQ ID NO: 10050047 - DNA, 22 bp, Homo sapiens
atgctaatgagctaaggagtcc

SEQ ID NO: 10050048 - DNA, 22 bp, Homo sapiens
atgcctggatttgggactcaaa

SEQ ID NO: 10050049 - DNA, 22 bp, Homo sapiens
atgctaaagctttgctttcatt

SEQ ID NO: 10050050 - DNA, 22 bp, Homo sapiens
atgctaaaggggtaggcctcct

SEQ ID NO: 10050051 - DNA, 22 bp, Homo sapiens
atgctaaatggccagtaccaaa

SEQ ID NO: 10050052 - DNA, 22 bp, Homo sapiens
atgctaaatccagaagcagtca

SEQ ID NO: 10050053 - DNA, 22 bp, Homo sapiens
gaatttggggtgtgttatttca

SEQ ID NO: 10050054 - DNA, 22 bp, Homo sapiens
gaagctgcgtgtagccatactt

SEQ ID NO: 10050055 - DNA, 22 bp, Homo sapiens
atgcaggagagcatgtttaaga

SEQ ID NO: 10050056 - DNA, 19 bp, Homo sapiens
atgagcaggcaagacaagc

SEQ ID NO: 10050057 - DNA, 22 bp, Homo sapiens
atgagcaggaagagcacaaaga

SEQ ID NO: 10050058 - DNA, 22 bp, Homo sapiens
atgagctgggccatccagtgat

SEQ ID NO: 10050059 - DNA, 23 bp, Homo sapiens
atgacactcctgtgcgcaccctg

SEQ ID NO: 10050060 - DNA, 22 bp, Homo sapiens
ctttggcttttagatatccatt

SEQ ID NO: 10050061 - DNA, 22 bp, Homo sapiens
ctttggtaaatgtcaaaaagtt

SEQ ID NO: 10050062 - DNA, 21 bp, Homo sapiens
ctttggtatttcactcacata

SEQ ID NO: 10050063 - DNA, 22 bp, Homo sapiens
ctttgctgagctggttgttcaa

SEQ ID NO: 10050064 - DNA, 22 bp, Homo sapiens
ctttgctgttataatgatagct

SEQ ID NO: 10050065 - DNA, 22 bp, Homo sapiens
ctttggaaaaatacctggcata

SEQ ID NO: 10050066 - DNA, 22 bp, Homo sapiens
ctttggctctttagaattccct

SEQ ID NO: 10050067 - DNA, 22 bp, Homo sapiens
atgagaaatttattacaagcta

SEQ ID NO: 10050068 - DNA, 22 bp, Homo sapiens
atgagaggtttcgtcagaggaa

SEQ ID NO: 10050069 - DNA, 22 bp, Homo sapiens
ctttaccagattccattgcaag

SEQ ID NO: 10050070 - DNA, 22 bp, Homo sapiens
ctttattagatgtagactttct

SEQ ID NO: 10050071 - DNA, 22 bp, Homo sapiens
atctttgctattgtaaatcacg

SEQ ID NO: 10050072 - DNA, 22 bp, Homo sapiens
atctttgactgccattcttgac

SEQ ID NO: 10050073 - DNA, 20 bp, Homo sapiens
atctttggctcagaagcctt

SEQ ID NO: 10050074 - DNA, 22 bp, Homo sapiens
atctttctccatatacatcttt

SEQ ID NO: 10050075 - DNA, 21 bp, Homo sapiens
atctttattacgcagagaaga

SEQ ID NO: 10050076 - DNA, 22 bp, Homo sapiens
atctttatttattgagcactta

SEQ ID NO: 10050077 - DNA, 22 bp, Homo sapiens
aatgtctgctctactcaggagg

SEQ ID NO: 10050078 - DNA, 22 bp, Homo sapiens
aatgtctgaaaatcagactgca

SEQ ID NO: 10050079 - DNA, 22 bp, Homo sapiens
aatgtgttcagttaaatgaact

SEQ ID NO: 10050080 - DNA, 22 bp, Homo sapiens
aatgtattctctttataagata

SEQ ID NO: 10050081 - DNA, 22 bp, Homo sapiens
agacagggccactcatcctcac

SEQ ID NO: 10050082 - DNA, 22 bp, Homo sapiens
aatgtcaattaccagaacagaa

SEQ ID NO: 10050083 - DNA, 21 bp, Homo sapiens
agacactggtttagcattcat

SEQ ID NO: 10050084 - DNA, 19 bp, Homo sapiens
agacagagactgaaataga

SEQ ID NO: 10050085 - DNA, 22 bp, Homo sapiens
agacaggccactctggtctggt

SEQ ID NO: 10050086 - DNA, 21 bp, Homo sapiens
agacagagtgcagtctacata

SEQ ID NO: 10050087 - DNA, 22 bp, Homo sapiens
agaaggggagaagctaccagga

SEQ ID NO: 10050088 - DNA, 22 bp, Homo sapiens
aatgcaaactccactggagcag

SEQ ID NO: 10050089 - DNA, 22 bp, Homo sapiens
aatgcaaacttcttgttacttg

SEQ ID NO: 10050090 - DNA, 22 bp, Homo sapiens
aatgcaaactccactggagcag

SEQ ID NO: 10050091 - DNA, 19 bp, Homo sapiens
aatgtttaagagaaaaagg

SEQ ID NO: 10050092 - DNA, 22 bp, Homo sapiens
aatgttcattgattaaatgaat

SEQ ID NO: 10050093 - DNA, 22 bp, Homo sapiens
aatgttcagggcagccctgcta

SEQ ID NO: 10050094 - DNA, 22 bp, Homo sapiens
aatgttcaaacagatcacttag

SEQ ID NO: 10050095 - DNA, 22 bp, Homo sapiens
aattatgaggtagatatcacat

SEQ ID NO: 10050096 - DNA, 22 bp, Homo sapiens
aattatccacctttgcatgatt

SEQ ID NO: 10050097 - DNA, 22 bp, Homo sapiens
aattatcagatataaaactgca

SEQ ID NO: 10050098 - DNA, 20 bp, Homo sapiens
aattatataactccaacatt

SEQ ID NO: 10050099 - DNA, 22 bp, Homo sapiens
aatttacagttgctgatggtac

SEQ ID NO: 10050100 - DNA, 22 bp, Homo sapiens
aatttatatgtaattaggcaca

SEQ ID NO: 10050101 - DNA, 19 bp, Homo sapiens
acaaatgatgttgcactga

SEQ ID NO: 10050102 - DNA, 22 bp, Homo sapiens
acaaatgactcaaacaccactt

SEQ ID NO: 10050103 - DNA, 22 bp, Homo sapiens
acaaatgactatttggtacagg

SEQ ID NO: 10050104 - DNA, 22 bp, Homo sapiens
acaaacagagttgaaaaatagg

SEQ ID NO: 10050105 - DNA, 22 bp, Homo sapiens
acaaacagagttgaaaaatagg

SEQ ID NO: 10050106 - DNA, 22 bp, Homo sapiens
acaaaccagcttaagcaagatg

SEQ ID NO: 10050107 - DNA, 22 bp, Homo sapiens
acaaaccagcttaagcaagatg

SEQ ID NO: 10050108 - DNA, 22 bp, Homo sapiens
acaaaatttttagacaaggctt

SEQ ID NO: 10050109 - DNA, 22 bp, Homo sapiens
acaaaattacctagttattttc

SEQ ID NO: 10050110 - DNA, 22 bp, Homo sapiens
aattttatgccttgcacgttgg

SEQ ID NO: 10050111 - DNA, 22 bp, Homo sapiens
aatttgtgaatctgtctcttga

SEQ ID NO: 10050112 - DNA, 22 bp, Homo sapiens
acaattactcaactttgctgct

SEQ ID NO: 10050113 - DNA, 22 bp, Homo sapiens
acaattaccctggcttgataaa

SEQ ID NO: 10050114 - DNA, 22 bp, Homo sapiens
acaattagctgtgtgtctatct

SEQ ID NO: 10050115 - DNA, 22 bp, Homo sapiens
agatggggctcagtgtggaggc

SEQ ID NO: 10050116 - DNA, 22 bp, Homo sapiens
agatggggctgaaagttccaat

SEQ ID NO: 10050117 - DNA, 22 bp, Homo sapiens
agcacaggtacggagatgctac

SEQ ID NO: 10050118 - DNA, 22 bp, Homo sapiens
agcaagattgaggcttcctcag

SEQ ID NO: 10050119 - DNA, 22 bp, Homo sapiens
agatggggcagaatggagccat

SEQ ID NO: 10050120 - DNA, 19 bp, Homo sapiens
agatggggaagagtgtgag

SEQ ID NO: 10050121 - DNA, 19 bp, Homo sapiens
acaagtcacttacttagta

SEQ ID NO: 10050122 - DNA, 22 bp, Homo sapiens
acaaatggaacaatgaagactg

SEQ ID NO: 10050123 - DNA, 22 bp, Homo sapiens
acaaattgaccgcaagattcat

SEQ ID NO: 10050124 - DNA, 22 bp, Homo sapiens
acaccaaagtagaattaatgta

SEQ ID NO: 10050125 - DNA, 22 bp, Homo sapiens
acacatttgctaaaatgagctc

SEQ ID NO: 10050126 - DNA, 22 bp, Homo sapiens
acactgtctgggactcaggagt

SEQ ID NO: 10050127 - DNA, 22 bp, Homo sapiens
acactgtagactgttgaagtac

SEQ ID NO: 10050128 - DNA, 22 bp, Homo sapiens
acactgtaaagtgatgcttaaa

SEQ ID NO: 10050129 - DNA, 18 bp, Homo sapiens
acactgcagcagtctgct

SEQ ID NO: 10050130 - DNA, 22 bp, Homo sapiens
acactgtatgaaaacaggaaat

SEQ ID NO: 10050131 - DNA, 22 bp, Homo sapiens
acactgtaggagaaaggagttt

SEQ ID NO: 10050132 - DNA, 22 bp, Homo sapiens
acactgtagctgagggcatgcg

SEQ ID NO: 10050133 - DNA, 19 bp, Homo sapiens
acactgtagatatagctat

SEQ ID NO: 10050134 - DNA, 22 bp, Homo sapiens
acactgtagatatagagttagt

SEQ ID NO: 10050135 - DNA, 23 bp, Homo sapiens
agcagggccagaatacttgctgt

SEQ ID NO: 10050136 - DNA, 22 bp, Homo sapiens
acagaacaacaaggtggaccag

SEQ ID NO: 10050137 - DNA, 22 bp, Homo sapiens
agccacaggaaacagagacagc

SEQ ID NO: 10050138 - DNA, 22 bp, Homo sapiens
agcagcaggtgcttctggatct

SEQ ID NO: 10050139 - DNA, 22 bp, Homo sapiens
acacatatatttgcatatacac

SEQ ID NO: 10050140 - DNA, 22 bp, Homo sapiens
acacatatgtatgcatcatgtg

SEQ ID NO: 10050141 - DNA, 22 bp, Homo sapiens
acaattctgatggtttcccagt

SEQ ID NO: 10050142 - DNA, 22 bp, Homo sapiens
acaattctgggtatttatatag

SEQ ID NO: 10050143 - DNA, 22 bp, Homo sapiens
acacagatgggtagaaaacaga

SEQ ID NO: 10050144 - DNA, 22 bp, Homo sapiens
acacagattttacatgttatgc

SEQ ID NO: 10050145 - DNA, 22 bp, Homo sapiens
acacagatttcactggaataga

SEQ ID NO: 10050146 - DNA, 22 bp, Homo sapiens
acacaggagaaaagatctccca

SEQ ID NO: 10050147 - DNA, 22 bp, Homo sapiens
agccatttcatacacctgcagc

SEQ ID NO: 10050148 - DNA, 22 bp, Homo sapiens
agccatggcgccactagaggga

SEQ ID NO: 10050149 - DNA, 22 bp, Homo sapiens
agccacagtcaacctgtccata

SEQ ID NO: 10050150 - DNA, 22 bp, Homo sapiens
agccacagtcaacctgtccata

SEQ ID NO: 10050151 - DNA, 22 bp, Homo sapiens
agccacagtctgatgcctgaga

SEQ ID NO: 10050152 - DNA, 22 bp, Homo sapiens
agccatttcctgaactctggac

SEQ ID NO: 10050153 - DNA, 22 bp, Homo sapiens
agccatttggacttctggtagg

SEQ ID NO: 10050154 - DNA, 22 bp, Homo sapiens
agccattttcctgaaatataac

SEQ ID NO: 10050155 - DNA, 22 bp, Homo sapiens
acagagtggagttcagtaaata

SEQ ID NO: 10050156 - DNA, 22 bp, Homo sapiens
acagagttaatggataggcagg

SEQ ID NO: 10050157 - DNA, 19 bp, Homo sapiens
agcccccagacagcaggcc

SEQ ID NO: 10050158 - DNA, 17 bp, Homo sapiens
agcctgccccatgctgc

SEQ ID NO: 10050159 - DNA, 22 bp, Homo sapiens
acagcaaaggacgaacactctg

SEQ ID NO: 10050160 - DNA, 17 bp, Homo sapiens
agcctgctgatctcaca

SEQ ID NO: 10050161 - DNA, 22 bp, Homo sapiens
aaggcagaaagggatgtgagtg

SEQ ID NO: 10050162 - DNA, 22 bp, Homo sapiens
aaggcagaaagggatgtgagtg

SEQ ID NO: 10050163 - DNA, 22 bp, Homo sapiens
aaggcaggatgcggacccatct

SEQ ID NO: 10050164 - DNA, 22 bp, Homo sapiens
aaggcagatataaagactagag

SEQ ID NO: 10050165 - DNA, 22 bp, Homo sapiens
aaggaaaggatgagcatgcatt

SEQ ID NO: 10050166 - DNA, 22 bp, Homo sapiens
acaggcagttgaggtttgtgtg

SEQ ID NO: 10050167 - DNA, 22 bp, Homo sapiens
acagtactctaatgaaaagtgc

SEQ ID NO: 10050168 - DNA, 22 bp, Homo sapiens
aagctgcactacttgagggacc

SEQ ID NO: 10050169 - DNA, 22 bp, Homo sapiens
aagccagggattcctgagggag

SEQ ID NO: 10050170 - DNA, 22 bp, Homo sapiens
aagccaggtgtttaggccagcg

SEQ ID NO: 10050171 - DNA, 22 bp, Homo sapiens
aagggctcggtagcagtcctga

SEQ ID NO: 10050172 - DNA, 22 bp, Homo sapiens
aaggctgcctctgccagaggag

SEQ ID NO: 10050173 - DNA, 22 bp, Homo sapiens
aaggcataggacaaatcagtga

SEQ ID NO: 10050174 - DNA, 21 bp, Homo sapiens
acccccacacctccttagttc

SEQ ID NO: 10050175 - DNA, 22 bp, Homo sapiens
acccccacggaaggccgtacgc

SEQ ID NO: 10050176 - DNA, 22 bp, Homo sapiens
aagtcacaagcatatatgcatt

SEQ ID NO: 10050177 - DNA, 22 bp, Homo sapiens
aagtacatatatttatgattct

SEQ ID NO: 10050178 - DNA, 23 bp, Homo sapiens
aagtacatatatttagatagtga

SEQ ID NO: 10050179 - DNA, 23 bp, Homo sapiens
aagtacatatatttagatagtga

SEQ ID NO: 10050180 - DNA, 22 bp, Homo sapiens
aagtacatcctagtctctttca

SEQ ID NO: 10050181 - DNA, 22 bp, Homo sapiens
aagtacatgctgtaatgattgg

SEQ ID NO: 10050182 - DNA, 22 bp, Homo sapiens
aaggtgaactggtaatgacaga

SEQ ID NO: 10050183 - DNA, 22 bp, Homo sapiens
aaggtctgtgaggctgtttgtc

SEQ ID NO: 10050184 - DNA, 22 bp, Homo sapiens
accatcagtcattgtcagtggg

SEQ ID NO: 10050185 - DNA, 22 bp, Homo sapiens
accatcttttcctctgcctcct

SEQ ID NO: 10050186 - DNA, 22 bp, Homo sapiens
aataattagtgggacagagaac

SEQ ID NO: 10050187 - DNA, 22 bp, Homo sapiens
aataattatttgagagcagacc

SEQ ID NO: 10050188 - DNA, 22 bp, Homo sapiens
aatacaagatttatagttgttt

SEQ ID NO: 10050189 - DNA, 22 bp, Homo sapiens
aataagatcttaaaggttatat

SEQ ID NO: 10050190 - DNA, 23 bp, Homo sapiens
actgcctgtgccgatctctctca

SEQ ID NO: 10050191 - DNA, 23 bp, Homo sapiens
actgcctgtgccgatctctctca

SEQ ID NO: 10050192 - DNA, 22 bp, Homo sapiens
actgcctgtgtcccttcagtgc

SEQ ID NO: 10050193 - DNA, 22 bp, Homo sapiens
actgcctgtttggcatggcccc

SEQ ID NO: 10050194 - DNA, 22 bp, Homo sapiens
aagtttcattgttcatgtaaca

SEQ ID NO: 10050195 - DNA, 22 bp, Homo sapiens
aagtttatgttggtaagatatc

SEQ ID NO: 10050196 - DNA, 22 bp, Homo sapiens
aagttacattttggtctaattg

SEQ ID NO: 10050197 - DNA, 22 bp, Homo sapiens
actacaaaagcactgggtatta

SEQ ID NO: 10050198 - DNA, 22 bp, Homo sapiens
aagtcacagctaaatagctaag

SEQ ID NO: 10050199 - DNA, 22 bp, Homo sapiens
aagtcacagagttggaagtcag

SEQ ID NO: 10050200 - DNA, 22 bp, Homo sapiens
aagtcagagcaactgagacatt

SEQ ID NO: 10050201 - DNA, 22 bp, Homo sapiens
aagtgcttggctaatggttatg

SEQ ID NO: 10050202 - DNA, 22 bp, Homo sapiens
aatcccttcccttctctgggac

SEQ ID NO: 10050203 - DNA, 22 bp, Homo sapiens
aatccatagaataaaattgcag

SEQ ID NO: 10050204 - DNA, 22 bp, Homo sapiens
actttaaaaagagccttctaac

SEQ ID NO: 10050205 - DNA, 22 bp, Homo sapiens
aatcaagagctgactatatttt

SEQ ID NO: 10050206 - DNA, 22 bp, Homo sapiens
acttgtctttaatccgaatgta

SEQ ID NO: 10050207 - DNA, 22 bp, Homo sapiens
acttgtctggcagatcatgcaa

SEQ ID NO: 10050208 - DNA, 22 bp, Homo sapiens
acttgtctatggttacatccta

SEQ ID NO: 10050209 - DNA, 22 bp, Homo sapiens
acttgtctttgtaaaatagaaa

SEQ ID NO: 10050210 - DNA, 22 bp, Homo sapiens
acttgtctaccatgaatattta

SEQ ID NO: 10050211 - DNA, 22 bp, Homo sapiens
acttgtatggagacttggaacc

SEQ ID NO: 10050212 - DNA, 22 bp, Homo sapiens
aatcaaagaatgggctagttgg

SEQ ID NO: 10050213 - DNA, 22 bp, Homo sapiens
aatacaatcaaattcactagca

SEQ ID NO: 10050214 - DNA, 22 bp, Homo sapiens
aatgaacatgggagtactaata

SEQ ID NO: 10050215 - DNA, 22 bp, Homo sapiens
aatgaacatcaaatgcctacca

SEQ ID NO: 10050216 - DNA, 22 bp, Homo sapiens
aatgaacagatacacataggca

SEQ ID NO: 10050217 - DNA, 22 bp, Homo sapiens
aatgaacacatgtggtcagttt

SEQ ID NO: 10050218 - DNA, 22 bp, Homo sapiens
agaaaactgcagagtagcctca

SEQ ID NO: 10050219 - DNA, 22 bp, Homo sapiens
agaaaacattacataggtgtgt

SEQ ID NO: 10050220 - DNA, 22 bp, Homo sapiens
aatgacatgctttttaattata

SEQ ID NO: 10050221 - DNA, 22 bp, Homo sapiens
aatgagttattaggtgtaagtg

SEQ ID NO: 10050222 - DNA, 19 bp, Homo sapiens
aatgagttccatgaaaaga

SEQ ID NO: 10050223 - DNA, 20 bp, Homo sapiens
aatgagttattttgtatatg

SEQ ID NO: 10050224 - DNA, 22 bp, Homo sapiens
aatgagctgctgctgttccacc

SEQ ID NO: 10050225 - DNA, 22 bp, Homo sapiens
aactaacagtcattaaaagaac

SEQ ID NO: 10050226 - DNA, 22 bp, Homo sapiens
aactaaaactggtttgttctct

SEQ ID NO: 10050227 - DNA, 22 bp, Homo sapiens
aaaggttattattactattgtc

SEQ ID NO: 10050228 - DNA, 22 bp, Homo sapiens
aaagtcaaggtttagactagag

SEQ ID NO: 10050229 - DNA, 22 bp, Homo sapiens
aaagtcaaggtttagactagag

SEQ ID NO: 10050230 - DNA, 22 bp, Homo sapiens
aaagtgtactatgtcatgaaca

SEQ ID NO: 10050231 - DNA, 22 bp, Homo sapiens
aaagtagtataaaattcatgtg

SEQ ID NO: 10050232 - DNA, 22 bp, Homo sapiens
aaagtagtccttggagcgaaat

SEQ ID NO: 10050233 - DNA, 22 bp, Homo sapiens
aaagtagttagtcatgtgaaaa

SEQ ID NO: 10050234 - DNA, 22 bp, Homo sapiens
aaagccatgaatgttatagagg

SEQ ID NO: 10050235 - DNA, 22 bp, Homo sapiens
aaagccatctgtattaagtgaa

SEQ ID NO: 10050236 - DNA, 22 bp, Homo sapiens
aacagatataggcagaactttg

SEQ ID NO: 10050237 - DNA, 22 bp, Homo sapiens
aacagataatttctaagttact

SEQ ID NO: 10050238 - DNA, 22 bp, Homo sapiens
aacagcaagggcggggtcaaga

SEQ ID NO: 10050239 - DNA, 22 bp, Homo sapiens
aacagatataggcagaactttg

SEQ ID NO: 10050240 - DNA, 22 bp, Homo sapiens
aaagctgccctacacggaagca

SEQ ID NO: 10050241 - DNA, 22 bp, Homo sapiens
aaagctttgggtaggaatggga

SEQ ID NO: 10050242 - DNA, 18 bp, Homo sapiens
aaagctgttattccagaa

SEQ ID NO: 10050243 - DNA, 22 bp, Homo sapiens
aaagatacttaatagttgtctg

SEQ ID NO: 10050244 - DNA, 22 bp, Homo sapiens
aacaaaacatttgtcttgtttc

SEQ ID NO: 10050245 - DNA, 22 bp, Homo sapiens
aacaaaacatttgtcttgtttc

SEQ ID NO: 10050246 - DNA, 22 bp, Homo sapiens
aacaaaacatttgtcttgtttc

SEQ ID NO: 10050247 - DNA, 22 bp, Homo sapiens
aaagatcaatagataaagctac

SEQ ID NO: 10050248 - DNA, 22 bp, Homo sapiens
aaagatcacgtcccaggactcg

SEQ ID NO: 10050249 - DNA, 22 bp, Homo sapiens
aaagatatgtctccaaagagat

SEQ ID NO: 10050250 - DNA, 20 bp, Homo sapiens
aaagatactttttgtaatgg

SEQ ID NO: 10050251 - DNA, 22 bp, Homo sapiens
aaagccataagcctaatactaa

SEQ ID NO: 10050252 - DNA, 22 bp, Homo sapiens
aaagccatcagtaaaatgattt

SEQ ID NO: 10050253 - DNA, 22 bp, Homo sapiens
aaatagaattggaagcagagtt

SEQ ID NO: 10050254 - DNA, 22 bp, Homo sapiens
aaatactgtagataatagagtt

SEQ ID NO: 10050255 - DNA, 22 bp, Homo sapiens
aaataattgagttggtcaatat

SEQ ID NO: 10050256 - DNA, 22 bp, Homo sapiens
aaataattatagcgagtctatc

SEQ ID NO: 10050257 - DNA, 22 bp, Homo sapiens
aaatagcataaaataggaagct

SEQ ID NO: 10050258 - DNA, 22 bp, Homo sapiens
aaatagcagctttgacagcaca

SEQ ID NO: 10050259 - DNA, 23 bp, Homo sapiens
aaataggagtatctggatcatga

SEQ ID NO: 10050260 - DNA, 22 bp, Homo sapiens
aaatcagatgcttcctagttgg

SEQ ID NO: 10050261 - DNA, 22 bp, Homo sapiens
aaagtgttgggaagaaagtgca

SEQ ID NO: 10050262 - DNA, 22 bp, Homo sapiens
aaagtgttttccatgcaatgaa

SEQ ID NO: 10050263 - DNA, 21 bp, Homo sapiens
aaagtgttcagaccagttctg

SEQ ID NO: 10050264 - DNA, 23 bp, Homo sapiens
aaagtgtagccaggttaagaacc

SEQ ID NO: 10050265 - DNA, 21 bp, Homo sapiens
aaagtgtgtggggaagaagga

SEQ ID NO: 10050266 - DNA, 22 bp, Homo sapiens
aaatcctttggaggacatgatg

SEQ ID NO: 10050267 - DNA, 22 bp, Homo sapiens
aaatccttttctatacagcata

SEQ ID NO: 10050268 - DNA, 22 bp, Homo sapiens
aaatccttttctatacagcata

SEQ ID NO: 10050269 - DNA, 22 bp, Homo sapiens
aaatgcaggaaattatgctttt

SEQ ID NO: 10050270 - DNA, 22 bp, Homo sapiens
aaatgtactgatacttatttta

SEQ ID NO: 10050271 - DNA, 22 bp, Homo sapiens
aaatgtaccttgatagtttggt

SEQ ID NO: 10050272 - DNA, 22 bp, Homo sapiens
aagcatcaacctgtatgctgca

SEQ ID NO: 10050273 - DNA, 22 bp, Homo sapiens
aaacctatatagtcttagaagc

SEQ ID NO: 10050274 - DNA, 22 bp, Homo sapiens
aaaggtggagttgtgcccattt

SEQ ID NO: 10050275 - DNA, 22 bp, Homo sapiens
aaaccttcacatctactctaca

SEQ ID NO: 10050276 - DNA, 22 bp, Homo sapiens
aaacctcttttaaggagttgtt

SEQ ID NO: 10050277 - DNA, 22 bp, Homo sapiens
aaactagatgaaacgagtaaag

SEQ ID NO: 10050278 - DNA, 22 bp, Homo sapiens
aaagttactatcacaatgaaat

SEQ ID NO: 10050279 - DNA, 22 bp, Homo sapiens
aaagttactttgctgtgcttca

SEQ ID NO: 10050280 - DNA, 22 bp, Homo sapiens
aaacaatgacaacacagctgcg

SEQ ID NO: 10050281 - DNA, 18 bp, Homo sapiens
aaacagtgcctaagtgtc

SEQ ID NO: 10050282 - DNA, 22 bp, Homo sapiens
aaagggtcagattctgctagtg

SEQ ID NO: 10050283 - DNA, 22 bp, Homo sapiens
aaagggtccagatacttggaaa

SEQ ID NO: 10050284 - DNA, 22 bp, Homo sapiens
aaattacagccttgggtagctt

SEQ ID NO: 10050285 - DNA, 22 bp, Homo sapiens
aaattaccattgtaaagtattt

SEQ ID NO: 10050286 - DNA, 20 bp, Homo sapiens
aaattactgccacacatttc

SEQ ID NO: 10050287 - DNA, 22 bp, Homo sapiens
aaattacagatcaccaatgcat

SEQ ID NO: 10050288 - DNA, 22 bp, Homo sapiens
aaagagttcttgtagctttgag

SEQ ID NO: 10050289 - DNA, 22 bp, Homo sapiens
aaagagttgaggcagttatcca

SEQ ID NO: 10050290 - DNA, 22 bp, Homo sapiens
aaagagttcacggaggccaaag

SEQ ID NO: 10050291 - DNA, 22 bp, Homo sapiens
aaagagcatggaaagttcagga

SEQ ID NO: 10050292 - DNA, 22 bp, Homo sapiens
aaagacacaaatgtagaccaaa

SEQ ID NO: 10050293 - DNA, 22 bp, Homo sapiens
aaagacacaaatgtagaccaaa

SEQ ID NO: 10050294 - DNA, 22 bp, Homo sapiens
aaactgataaaataagtacatt

SEQ ID NO: 10050295 - DNA, 21 bp, Homo sapiens
aaagaacaggcagatgttctt

SEQ ID NO: 10050296 - DNA, 22 bp, Homo sapiens
aaagaagtgttgaatttgcaag

SEQ ID NO: 10050297 - DNA, 17 bp, Homo sapiens
aaactgaaaaattcact

SEQ ID NO: 10050298 - DNA, 22 bp, Homo sapiens
aaactcttttgcatattagagg

SEQ ID NO: 10050299 - DNA, 21 bp, Homo sapiens
aaactgaccttgcctgagaca

SEQ ID NO: 10050300 - DNA, 22 bp, Homo sapiens
aaagacatggaactagagatgg

SEQ ID NO: 10050301 - DNA, 22 bp, Homo sapiens
aaagacatggaactagagatgg

SEQ ID NO: 10050302 - DNA, 22 bp, Homo sapiens
aaaagagaatcctgtacagaga

SEQ ID NO: 10050303 - DNA, 22 bp, Homo sapiens
aaactagatgattatgaagcat

SEQ ID NO: 10050304 - DNA, 22 bp, Homo sapiens
aaaagagagttgccagtctgta

SEQ ID NO: 10050305 - DNA, 21 bp, Homo sapiens
aaactagcagcaaccatgatc

SEQ ID NO: 10050306 - DNA, 22 bp, Homo sapiens
aaactcaaattaaactagctta

SEQ ID NO: 10050307 - DNA, 22 bp, Homo sapiens
aaaatcctctaattctagaata

SEQ ID NO: 10050308 - DNA, 22 bp, Homo sapiens
aaaatcctgctgactcgagatg

SEQ ID NO: 10050309 - DNA, 22 bp, Homo sapiens
aaaatcctgctgactcgagatg

SEQ ID NO: 10050310 - DNA, 22 bp, Homo sapiens
aaaatcacaagcttgggtcact

SEQ ID NO: 10050311 - DNA, 22 bp, Homo sapiens
aaagactaagaagagtattatt

SEQ ID NO: 10050312 - DNA, 21 bp, Homo sapiens
aaaatcaccttaggtcactgg

SEQ ID NO: 10050313 - DNA, 22 bp, Homo sapiens
aaagactaaacaaccaatatct

SEQ ID NO: 10050314 - DNA, 22 bp, Homo sapiens
aaagacctgtggtagctctaaa

SEQ ID NO: 10050315 - DNA, 22 bp, Homo sapiens
aaagaccatgtttacagctagg

SEQ ID NO: 10050316 - DNA, 22 bp, Homo sapiens
aaagacattagcttagatgtca

SEQ ID NO: 10050317 - DNA, 22 bp, Homo sapiens
aaagacattagcttagatgtca

SEQ ID NO: 10050318 - DNA, 22 bp, Homo sapiens
aaacaatgaaattcattcttca

SEQ ID NO: 10050319 - DNA, 22 bp, Homo sapiens
aaacaatgaaatatttttatgg

SEQ ID NO: 10050320 - DNA, 22 bp, Homo sapiens
aaacaatccaggaacctgttta

SEQ ID NO: 10050321 - DNA, 23 bp, Homo sapiens
aaacaagtctctcaatggcttgc

SEQ ID NO: 10050322 - DNA, 22 bp, Homo sapiens
aaacaagtgtaaactagtctgt

SEQ ID NO: 10050323 - DNA, 22 bp, Homo sapiens
aaaaacacaactgtctttctct

SEQ ID NO: 10050324 - DNA, 22 bp, Homo sapiens
aaaaacacaagtggcttggtct

SEQ ID NO: 10050325 - DNA, 22 bp, Homo sapiens
aaaaacagaatgtgtctaactc

SEQ ID NO: 10050326 - DNA, 22 bp, Homo sapiens
aaaaacagaatgtgtctaactc

SEQ ID NO: 10050327 - DNA, 20 bp, Homo sapiens
aaaaacagtaatgctgaaga

SEQ ID NO: 10050328 - DNA, 22 bp, Homo sapiens
aaaaaatcagatctttggttaa

SEQ ID NO: 10050329 - DNA, 23 bp, Homo sapiens
aaaaaaccatgtaggcactcagt

SEQ ID NO: 10050330 - DNA, 23 bp, Homo sapiens
aaaaaaccatgtaggcactcagt

SEQ ID NO: 10050331 - DNA, 20 bp, Homo sapiens
aaaaacagtaatgctgaaga

SEQ ID NO: 10050332 - DNA, 22 bp, Homo sapiens
aaaaaccattgtcttcagtctc

SEQ ID NO: 10050333 - DNA, 22 bp, Homo sapiens
aaaaactgcaattacttttgtc

SEQ ID NO: 10050334 - DNA, 22 bp, Homo sapiens
aaaatcttgtgacttaggaagg

SEQ ID NO: 10050335 - DNA, 23 bp, Homo sapiens
aaaatcttctgcctatgaagaaa

SEQ ID NO: 10050336 - DNA, 22 bp, Homo sapiens
aaacagagagatgtatgtggag

SEQ ID NO: 10050337 - DNA, 22 bp, Homo sapiens
aaaagacaggtgtctgcggccc

SEQ ID NO: 10050338 - DNA, 22 bp, Homo sapiens
aaacagactgcactgccagtca

SEQ ID NO: 10050339 - DNA, 22 bp, Homo sapiens
aaacagactgcactgccagtca

SEQ ID NO: 10050340 - DNA, 22 bp, Homo sapiens
aaaagacatatgtgggcattct

SEQ ID NO: 10050341 - DNA, 22 bp, Homo sapiens
aaaagacatctatttcaggcag

SEQ ID NO: 10050342 - DNA, 22 bp, Homo sapiens
aaacacttcctgtaacatgaca

SEQ ID NO: 10050343 - DNA, 22 bp, Homo sapiens
aaacagaaatttcctcatgctc

SEQ ID NO: 10050344 - DNA, 22 bp, Homo sapiens
aaaatgacattccagtgatatt

SEQ ID NO: 10050345 - DNA, 22 bp, Homo sapiens
aaattccattttgtgactattc

SEQ ID NO: 10050346 - DNA, 22 bp, Homo sapiens
aaattcctgtcatttgcacttt

SEQ ID NO: 10050347 - DNA, 22 bp, Homo sapiens
aacaaacagttaagtgtggatg

SEQ ID NO: 10050348 - DNA, 20 bp, Homo sapiens
aacaaactacaaaattatgt

SEQ ID NO: 10050349 - DNA, 22 bp, Homo sapiens
aacaaacctgggtggagaaagg

SEQ ID NO: 10050350 - DNA, 22 bp, Homo sapiens
aacaaacattacctggtgctgg

SEQ ID NO: 10050351 - DNA, 22 bp, Homo sapiens
aacaaaccttccctatacgtct

SEQ ID NO: 10050352 - DNA, 22 bp, Homo sapiens
aaattcttcaggtaattttgat

SEQ ID NO: 10050353 - DNA, 17 bp, Homo sapiens
aagtccagcctgcagct

SEQ ID NO: 10050354 - DNA, 17 bp, Homo sapiens
aagtccagagttgagca

SEQ ID NO: 10050355 - DNA, 22 bp, Homo sapiens
aagtccagcagtgcttgttgat

SEQ ID NO: 10050356 - DNA, 22 bp, Homo sapiens
aagtccagactcctttgcgtgg

SEQ ID NO: 10050357 - DNA, 22 bp, Homo sapiens
aagtccagaactcctgtgatag

SEQ ID NO: 10050358 - DNA, 22 bp, Homo sapiens
aagtcattggtagcttgatagg

SEQ ID NO: 10050359 - DNA, 22 bp, Homo sapiens
aacaaatggaacacaaatcttt

SEQ ID NO: 10050360 - DNA, 23 bp, Homo sapiens
aacaccaaggctcagagagataa

SEQ ID NO: 10050361 - DNA, 22 bp, Homo sapiens
aacactgacctctaccctcagt

SEQ ID NO: 10050362 - DNA, 22 bp, Homo sapiens
aaggtcagagcaggaaggagtc

SEQ ID NO: 10050363 - DNA, 22 bp, Homo sapiens
aaccaccaccatctagttccaa

SEQ ID NO: 10050364 - DNA, 22 bp, Homo sapiens
aaccaccaccgtaatttaccca

SEQ ID NO: 10050365 - DNA, 22 bp, Homo sapiens
aataacttttaaaagaccctgg

SEQ ID NO: 10050366 - DNA, 20 bp, Homo sapiens
aaccaacagaatcatgtctc

SEQ ID NO: 10050367 - DNA, 22 bp, Homo sapiens
aacatgtaaatatcattgtact

SEQ ID NO: 10050368 - DNA, 22 bp, Homo sapiens
aacatgaaaagcccagagaggt

SEQ ID NO: 10050369 - DNA, 18 bp, Homo sapiens
aacatgcattagaactgc

SEQ ID NO: 10050370 - DNA, 18 bp, Homo sapiens
aacaggatcctccacttc

SEQ ID NO: 10050371 - DNA, 22 bp, Homo sapiens
aacaggaccttccaatccatca

SEQ ID NO: 10050372 - DNA, 22 bp, Homo sapiens
aacaggcctatagggaaggcgc

SEQ ID NO: 10050373 - DNA, 22 bp, Homo sapiens
aacaggccctaggaattgggcc

SEQ ID NO: 10050374 - DNA, 22 bp, Homo sapiens
aacttaggaaaataaggcatga

SEQ ID NO: 10050375 - DNA, 22 bp, Homo sapiens
aacttaggaaaataaggcatga

SEQ ID NO: 10050376 - DNA, 22 bp, Homo sapiens
aatataacacagatggcctgtt

SEQ ID NO: 10050377 - DNA, 22 bp, Homo sapiens
aacgtcttctctccaagtaaat

SEQ ID NO: 10050378 - DNA, 18 bp, Homo sapiens
acagacaaaatggaaatg

SEQ ID NO: 10050379 - DNA, 22 bp, Homo sapiens
aagcagcatgattgtaatacta

SEQ ID NO: 10050380 - DNA, 22 bp, Homo sapiens
aagcagcatgtgggttatcggg

SEQ ID NO: 10050381 - DNA, 22 bp, Homo sapiens
aagcagcattgtaaccaatgcc

SEQ ID NO: 10050382 - DNA, 23 bp, Homo sapiens
acagagtacagtgtgcttagtgg

SEQ ID NO: 10050383 - DNA, 22 bp, Homo sapiens
aagcagccagccatcatgcccg

SEQ ID NO: 10050384 - DNA, 22 bp, Homo sapiens
acagcagctgccttcaggctct

SEQ ID NO: 10050385 - DNA, 22 bp, Homo sapiens
aagccagctccagcatatcact

SEQ ID NO: 10050386 - DNA, 22 bp, Homo sapiens
aagccagcctgtttccttcttc

SEQ ID NO: 10050387 - DNA, 22 bp, Homo sapiens
aagcatttatagataagaattt

SEQ ID NO: 10050388 - DNA, 22 bp, Homo sapiens
aagcatcaacactatattgatg

SEQ ID NO: 10050389 - DNA, 22 bp, Homo sapiens
aagcatttggttctgaagactc

SEQ ID NO: 10050390 - DNA, 22 bp, Homo sapiens
aagcacagggactttaggaata

SEQ ID NO: 10050391 - DNA, 22 bp, Homo sapiens
acactgcatttcaacaaggccc

SEQ ID NO: 10050392 - DNA, 21 bp, Homo sapiens
acactgcaggtgaagtgcact

SEQ ID NO: 10050393 - DNA, 21 bp, Homo sapiens
acactgctgtagcatattggg

SEQ ID NO: 10050394 - DNA, 22 bp, Homo sapiens
acacaggttccatctccacctt

SEQ ID NO: 10050395 - DNA, 23 bp, Homo sapiens
aagagcagggaatatttatttgc

SEQ ID NO: 10050396 - DNA, 19 bp, Homo sapiens
aagagcagggaaagaattg

SEQ ID NO: 10050397 - DNA, 22 bp, Homo sapiens
aagagctgcacatatttatatc

SEQ ID NO: 10050398 - DNA, 20 bp, Homo sapiens
aagagctgactcacagtggt

SEQ ID NO: 10050399 - DNA, 22 bp, Homo sapiens
aagagctggagctgctacagga

SEQ ID NO: 10050400 - DNA, 22 bp, Homo sapiens
aagagctggtcacaggtccatt

SEQ ID NO: 10050401 - DNA, 22 bp, Homo sapiens
aagagctgtatgccatatgatt

SEQ ID NO: 10050402 - DNA, 20 bp, Homo sapiens
acaaagactggaaaagcaag

SEQ ID NO: 10050403 - DNA, 22 bp, Homo sapiens
aagacatgcaattagcaaggaa

SEQ ID NO: 10050404 - DNA, 22 bp, Homo sapiens
acaaggacataggaaactacaa

SEQ ID NO: 10050405 - DNA, 22 bp, Homo sapiens
aagacactaagctttcaggata

SEQ ID NO: 10050406 - DNA, 22 bp, Homo sapiens
aagacacagcgaaatgttcctg

SEQ ID NO: 10050407 - DNA, 22 bp, Homo sapiens
aagacagtgatctctgagagat

SEQ ID NO: 10050408 - DNA, 22 bp, Homo sapiens
aagacagtgacagtcacaattg

SEQ ID NO: 10050409 - DNA, 20 bp, Homo sapiens
aagaagttggtaagcagtgc

SEQ ID NO: 10050410 - DNA, 21 bp, Homo sapiens
aagaagtttggattttgtcct

SEQ ID NO: 10050411 - DNA, 22 bp, Homo sapiens
aagaaataagacttctctgtcc

SEQ ID NO: 10050412 - DNA, 22 bp, Homo sapiens
aatgttttgcattagttttcta

SEQ ID NO: 10050413 - DNA, 22 bp, Homo sapiens
agatacattagtagttacttgt

SEQ ID NO: 10050414 - DNA, 22 bp, Homo sapiens
agataaacccaacttaatgaag

SEQ ID NO: 10050415 - DNA, 23 bp, Homo sapiens
agagtttgtttctaatgagtgag

SEQ ID NO: 10050416 - DNA, 22 bp, Homo sapiens
agagtttgtactttaccctgag

SEQ ID NO: 10050417 - DNA, 22 bp, Homo sapiens
agagtttgggtgggacagcttg

SEQ ID NO: 10050418 - DNA, 22 bp, Homo sapiens
agagtttgaattttgaaaagat

SEQ ID NO: 10050419 - DNA, 22 bp, Homo sapiens
agagtttggagagggtgaggca

SEQ ID NO: 10050420 - DNA, 22 bp, Homo sapiens
agagtttggaggtgttcctgga

SEQ ID NO: 10050421 - DNA, 22 bp, Homo sapiens
agagttctgtctgccacacgaa

SEQ ID NO: 10050422 - DNA, 21 bp, Homo sapiens
agagttcttgctgagcaagcc

SEQ ID NO: 10050423 - DNA, 22 bp, Homo sapiens
caaaagtaccttgtgtgctttg

SEQ ID NO: 10050424 - DNA, 22 bp, Homo sapiens
caaaaaacacagatgtctgtgt

SEQ ID NO: 10050425 - DNA, 21 bp, Homo sapiens
caaaaggataggaaattaggg

SEQ ID NO: 10050426 - DNA, 22 bp, Homo sapiens
atttcctgtgtctctatttatg

SEQ ID NO: 10050427 - DNA, 17 bp, Homo sapiens
atttcctgcaagcccct

SEQ ID NO: 10050428 - DNA, 22 bp, Homo sapiens
agaggcggaggttgcagtgagc

SEQ ID NO: 10050429 - DNA, 22 bp, Homo sapiens
agaggcggagcttgcagtgagc

SEQ ID NO: 10050430 - DNA, 22 bp, Homo sapiens
attcattagccactaactagca

SEQ ID NO: 10050431 - DNA, 22 bp, Homo sapiens
attcagtaggtctagaataaga

SEQ ID NO: 10050432 - DNA, 22 bp, Homo sapiens
attcagtaggtgtgaacttatt

SEQ ID NO: 10050433 - DNA, 23 bp, Homo sapiens
attccagagctagagtcaagtgg

SEQ ID NO: 10050434 - DNA, 22 bp, Homo sapiens
attccagatggcttcaagtaag

SEQ ID NO: 10050435 - DNA, 19 bp, Homo sapiens
attgcagctatagactgcc

SEQ ID NO: 10050436 - DNA, 22 bp, Homo sapiens
attgcagctcagggtgatgact

SEQ ID NO: 10050437 - DNA, 22 bp, Homo sapiens
attattcaacacttgagaaatt

SEQ ID NO: 10050438 - DNA, 21 bp, Homo sapiens
attattataaagaccacaggg

SEQ ID NO: 10050439 - DNA, 22 bp, Homo sapiens
attattatatagggaaagtccc

SEQ ID NO: 10050440 - DNA, 23 bp, Homo sapiens
attattaaggacatggactttgt

SEQ ID NO: 10050441 - DNA, 22 bp, Homo sapiens
agaggaggccaggcccacacct

SEQ ID NO: 10050442 - DNA, 22 bp, Homo sapiens
agaggaggcagcttaactcagt

SEQ ID NO: 10050443 - DNA, 22 bp, Homo sapiens
agaggaggctgggtccagataa

SEQ ID NO: 10050444 - DNA, 22 bp, Homo sapiens
agaggaggctctgggatcgtcc

SEQ ID NO: 10050445 - DNA, 22 bp, Homo sapiens
agaggacaaaatgagaagtgct

SEQ ID NO: 10050446 - DNA, 22 bp, Homo sapiens
atgtttatggagcaggtattag

SEQ ID NO: 10050447 - DNA, 22 bp, Homo sapiens
atgtttatgcaaacatgtgagt

SEQ ID NO: 10050448 - DNA, 22 bp, Homo sapiens
atgcactgcccctctgcacctc

SEQ ID NO: 10050449 - DNA, 22 bp, Homo sapiens
atgcactgtaagactagccatg

SEQ ID NO: 10050450 - DNA, 22 bp, Homo sapiens
atgcacctgaactccatcagct

SEQ ID NO: 10050451 - DNA, 22 bp, Homo sapiens
atgcacccagtgtctggactat

SEQ ID NO: 10050452 - DNA, 22 bp, Homo sapiens
atgcacatgaggcaagcaaaat

SEQ ID NO: 10050453 - DNA, 22 bp, Homo sapiens
atgacaagggttgacacatgtc

SEQ ID NO: 10050454 - DNA, 18 bp, Homo sapiens
agacagctgaaaggaaaa

SEQ ID NO: 10050455 - DNA, 22 bp, Homo sapiens
agacagcaggggagtctggttt

SEQ ID NO: 10050456 - DNA, 22 bp, Homo sapiens
agacagcatgagcctgctgatg

SEQ ID NO: 10050457 - DNA, 22 bp, Homo sapiens
agaagtcaatagttgtttgatg

SEQ ID NO: 10050458 - DNA, 22 bp, Homo sapiens
agaagtcaagtggtctatgaaa

SEQ ID NO: 10050459 - DNA, 22 bp, Homo sapiens
atctcaccaagttattacgaga

SEQ ID NO: 10050460 - DNA, 21 bp, Homo sapiens
agaagtcaattgaactgaaat

SEQ ID NO: 10050461 - DNA, 22 bp, Homo sapiens
agaagtttggtcctataaactc

SEQ ID NO: 10050462 - DNA, 22 bp, Homo sapiens
atctttgtgctaatgtagttct

SEQ ID NO: 10050463 - DNA, 22 bp, Homo sapiens
atgaaagatgatttaaagtact

SEQ ID NO: 10050464 - DNA, 22 bp, Homo sapiens
atgaaagcaacttatttgagat

SEQ ID NO: 10050465 - DNA, 22 bp, Homo sapiens
atgaaagcacgtgggaagataa

SEQ ID NO: 10050466 - DNA, 22 bp, Homo sapiens
atgaacaacttgaagctccatg

SEQ ID NO: 10050467 - DNA, 22 bp, Homo sapiens
atgaacaataatcatgtctatg

SEQ ID NO: 10050468 - DNA, 22 bp, Homo sapiens
agacaaatgaacaaatatgtga

SEQ ID NO: 10050469 - DNA, 22 bp, Homo sapiens
agacaaatggagtatgagcaac

SEQ ID NO: 10050470 - DNA, 22 bp, Homo sapiens
agagacagggttttgtcgtgtt

SEQ ID NO: 10050471 - DNA, 22 bp, Homo sapiens
atggctattttagagatcaagg

SEQ ID NO: 10050472 - DNA, 22 bp, Homo sapiens
agagaagacttacagccacagt

SEQ ID NO: 10050473 - DNA, 22 bp, Homo sapiens
atggccagctcagagcactcag

SEQ ID NO: 10050474 - DNA, 22 bp, Homo sapiens
atggccagcaaggtagggcaat

SEQ ID NO: 10050475 - DNA, 22 bp, Homo sapiens
agaccacttggataagaaacag

SEQ ID NO: 10050476 - DNA, 22 bp, Homo sapiens
agaccagggtcccacagagtct

SEQ ID NO: 10050477 - DNA, 22 bp, Homo sapiens
agacccacactttgagtagcaa

SEQ ID NO: 10050478 - DNA, 22 bp, Homo sapiens
atgggtggaggagaaaggcatc

SEQ ID NO: 10050479 - DNA, 22 bp, Homo sapiens
atgggtggagggtgacacggat

SEQ ID NO: 10050480 - DNA, 19 bp, Homo sapiens
agagccagacagcatagga

SEQ ID NO: 10050481 - DNA, 22 bp, Homo sapiens
agagccagaccattgccgtgca

SEQ ID NO: 10050482 - DNA, 22 bp, Homo sapiens
agagccactgggagacagagca

SEQ ID NO: 10050483 - DNA, 22 bp, Homo sapiens
agagccacagtggataggagcc

SEQ ID NO: 10050484 - DNA, 22 bp, Homo sapiens
agagatgaatcttgagactctg

SEQ ID NO: 10050485 - DNA, 22 bp, Homo sapiens
agagcctgggaatttgcatgtt

SEQ ID NO: 10050486 - DNA, 22 bp, Homo sapiens
agagcctgggcagctcctctgg

SEQ ID NO: 10050487 - DNA, 22 bp, Homo sapiens
atgtatttgcgtatggacatac

SEQ ID NO: 10050488 - DNA, 22 bp, Homo sapiens
agagccagatggagccgtgtgt

SEQ ID NO: 10050489 - DNA, 22 bp, Homo sapiens
agagcctgtgattgtcatcacc

SEQ ID NO: 10050490 - DNA, 22 bp, Homo sapiens
agagcctgtaacatctttctta

SEQ ID NO: 10050491 - DNA, 22 bp, Homo sapiens
agagcctgtctgcctttctacc

SEQ ID NO: 10050492 - DNA, 22 bp, Homo sapiens
agagcctgtcaattgtaaagag

SEQ ID NO: 10050493 - DNA, 22 bp, Homo sapiens
agagcctgtacttttctgtgaa

SEQ ID NO: 10050494 - DNA, 22 bp, Homo sapiens
cagctcaggcactggcgcggga

SEQ ID NO: 10050495 - DNA, 22 bp, Homo sapiens
cagcagttcaggctccttcccg

SEQ ID NO: 10050496 - DNA, 22 bp, Homo sapiens
cagcaggggaactgtgggccag

SEQ ID NO: 10050497 - DNA, 22 bp, Homo sapiens
cagccctgagaaggaggatctc

SEQ ID NO: 10050498 - DNA, 22 bp, Homo sapiens
agcctgagccccatccagctga

SEQ ID NO: 10050499 - DNA, 22 bp, Homo sapiens
cagcagcattgctctggattcc

SEQ ID NO: 10050500 - DNA, 22 bp, Homo sapiens
cagcagcattgctctggattcc

SEQ ID NO: 10050501 - DNA, 22 bp, Homo sapiens
cagcagctcactcaggtggctc

SEQ ID NO: 10050502 - DNA, 22 bp, Homo sapiens
agcctgagagccaagctgtgca

SEQ ID NO: 10050503 - DNA, 22 bp, Homo sapiens
agcctcttattctccaggactt

SEQ ID NO: 10050504 - DNA, 22 bp, Homo sapiens
agcctggcactgccccatccat

SEQ ID NO: 10050505 - DNA, 22 bp, Homo sapiens
cagagggccccctggccacagt

SEQ ID NO: 10050506 - DNA, 22 bp, Homo sapiens
cagagggccccctggccacagt

SEQ ID NO: 10050507 - DNA, 22 bp, Homo sapiens
cagagggcactcggagtgacat

SEQ ID NO: 10050508 - DNA, 22 bp, Homo sapiens
cagaggtgcatacaggtcatta

SEQ ID NO: 10050509 - DNA, 22 bp, Homo sapiens
agccactccttcagcgtctgct

SEQ ID NO: 10050510 - DNA, 22 bp, Homo sapiens
agccactcagtgctgtattgac

SEQ ID NO: 10050511 - DNA, 19 bp, Homo sapiens
cagaaatagcgaagtgtaa

SEQ ID NO: 10050512 - DNA, 22 bp, Homo sapiens
agccacaggaaacagagacagc

SEQ ID NO: 10050513 - DNA, 22 bp, Homo sapiens
agccacagtgcaagagagaaaa

SEQ ID NO: 10050514 - DNA, 22 bp, Homo sapiens
cagaatgtatatgatctaaggt

SEQ ID NO: 10050515 - DNA, 22 bp, Homo sapiens
cagaatgggaaggactgcagtt

SEQ ID NO: 10050516 - DNA, 22 bp, Homo sapiens
cagaatgcagaatgttcatttt

SEQ ID NO: 10050517 - DNA, 22 bp, Homo sapiens
cagagggagccctccaggagca

SEQ ID NO: 10050518 - DNA, 22 bp, Homo sapiens
agcccagggaaccaggaagtgg

SEQ ID NO: 10050519 - DNA, 20 bp, Homo sapiens
agcccaggcctgtgtgagtc

SEQ ID NO: 10050520 - DNA, 21 bp, Homo sapiens
cagaggcaggctctgtgtgtg

SEQ ID NO: 10050521 - DNA, 22 bp, Homo sapiens
cagaggcatactcccagtcttg

SEQ ID NO: 10050522 - DNA, 22 bp, Homo sapiens
agcacaggtgaaacagtcaggt

SEQ ID NO: 10050523 - DNA, 22 bp, Homo sapiens
caaaagtctgtcctttaacttc

SEQ ID NO: 10050524 - DNA, 22 bp, Homo sapiens
agcacattgatttattttggag

SEQ ID NO: 10050525 - DNA, 22 bp, Homo sapiens
cacaagaaataagctgcctttc

SEQ ID NO: 10050526 - DNA, 22 bp, Homo sapiens
cacaagaaataagctgcctttc

SEQ ID NO: 10050527 - DNA, 22 bp, Homo sapiens
cacaaggactggatggagtggg

SEQ ID NO: 10050528 - DNA, 22 bp, Homo sapiens
cacaaggaggtcctgaggaagc

SEQ ID NO: 10050529 - DNA, 22 bp, Homo sapiens
agcagcatttaagtttcttcta

SEQ ID NO: 10050530 - DNA, 22 bp, Homo sapiens
agcagccacacgcctccttctc

SEQ ID NO: 10050531 - DNA, 22 bp, Homo sapiens
agcagccagaaagggcagtcga

SEQ ID NO: 10050532 - DNA, 22 bp, Homo sapiens
agcagcaggaggccattgtctt

SEQ ID NO: 10050533 - DNA, 22 bp, Homo sapiens
caagcagaaatctagaactcca

SEQ ID NO: 10050534 - DNA, 22 bp, Homo sapiens
cacctacttccaagagtttcca

SEQ ID NO: 10050535 - DNA, 22 bp, Homo sapiens
cacccagggctgtgcctgccca

SEQ ID NO: 10050536 - DNA, 22 bp, Homo sapiens
agcagggtcctgaggtgagtca

SEQ ID NO: 10050537 - DNA, 22 bp, Homo sapiens
agcagggttctcagttggtgct

SEQ ID NO: 10050538 - DNA, 22 bp, Homo sapiens
agcagggctggggcacgagcca

SEQ ID NO: 10050539 - DNA, 21 bp, Homo sapiens
agcaggcaaaggtgaagtctt

SEQ ID NO: 10050540 - DNA, 22 bp, Homo sapiens
agcaggcacgctccctgcgcga

SEQ ID NO: 10050541 - DNA, 17 bp, Homo sapiens
agcaggcacgtcagcac

SEQ ID NO: 10050542 - DNA, 22 bp, Homo sapiens
agcaggcaccagggctcgtcct

SEQ ID NO: 10050543 - DNA, 17 bp, Homo sapiens
agcaggctgcagaggcc

SEQ ID NO: 10050544 - DNA, 22 bp, Homo sapiens
agcaggctgatgggcatgcttg

SEQ ID NO: 10050545 - DNA, 19 bp, Homo sapiens
cacagtcctatgtttatca

SEQ ID NO: 10050546 - DNA, 22 bp, Homo sapiens
cacagtcctacagagatcagag

SEQ ID NO: 10050547 - DNA, 22 bp, Homo sapiens
cacagtcccgtgcttaccatgt

SEQ ID NO: 10050548 - DNA, 22 bp, Homo sapiens
cacagtcccattcgagagtaat

SEQ ID NO: 10050549 - DNA, 22 bp, Homo sapiens
agcaggcaggaaggcagcactg

SEQ ID NO: 10050550 - DNA, 22 bp, Homo sapiens
agcaggcaggaaggcagcactg

SEQ ID NO: 10050551 - DNA, 22 bp, Homo sapiens
atctaaacaggtgttctttaga

SEQ ID NO: 10050552 - DNA, 22 bp, Homo sapiens
atctaaagtgtttcatgaaaga

SEQ ID NO: 10050553 - DNA, 22 bp, Homo sapiens
atctaaagtgtcataagtagct

SEQ ID NO: 10050554 - DNA, 22 bp, Homo sapiens
atctaaagtgtttcatgaaaga

SEQ ID NO: 10050555 - DNA, 22 bp, Homo sapiens
atctaaactatagtacctagtc

SEQ ID NO: 10050556 - DNA, 22 bp, Homo sapiens
atctcaaatgattacaccaagc

SEQ ID NO: 10050557 - DNA, 22 bp, Homo sapiens
atcatcttatctgactcatttt

SEQ ID NO: 10050558 - DNA, 22 bp, Homo sapiens
atcatcttgaaagtctatgttt

SEQ ID NO: 10050559 - DNA, 22 bp, Homo sapiens
atcatcttcatattcctcagct

SEQ ID NO: 10050560 - DNA, 22 bp, Homo sapiens
atcgctttacagcctgcttcct

SEQ ID NO: 10050561 - DNA, 22 bp, Homo sapiens
agaaagctccccatgagatgat

SEQ ID NO: 10050562 - DNA, 22 bp, Homo sapiens
agaacacttttaaatggcttgt

SEQ ID NO: 10050563 - DNA, 22 bp, Homo sapiens
agaacagcagtagtatacagta

SEQ ID NO: 10050564 - DNA, 22 bp, Homo sapiens
agaacagcagcacgtcaagctg

SEQ ID NO: 10050565 - DNA, 22 bp, Homo sapiens
agaacactgctagtataatcac

SEQ ID NO: 10050566 - DNA, 22 bp, Homo sapiens
atatgcttgggactgatacagt

SEQ ID NO: 10050567 - DNA, 22 bp, Homo sapiens
atatgctttgggattagatcat

SEQ ID NO: 10050568 - DNA, 22 bp, Homo sapiens
agaaaaggttgaaagtaggatt

SEQ ID NO: 10050569 - DNA, 22 bp, Homo sapiens
atatgcttatgatgtctcaagt

SEQ ID NO: 10050570 - DNA, 22 bp, Homo sapiens
atatgcttatgatggttaattt

SEQ ID NO: 10050571 - DNA, 22 bp, Homo sapiens
atatgcttccccttctttttgg

SEQ ID NO: 10050572 - DNA, 22 bp, Homo sapiens
atatgaaagtaagcatgtgtgt

SEQ ID NO: 10050573 - DNA, 22 bp, Homo sapiens
atatgaaagtaagcatgtgtgt

SEQ ID NO: 10050574 - DNA, 22 bp, Homo sapiens
actttcctgccaaggccagagt

SEQ ID NO: 10050575 - DNA, 22 bp, Homo sapiens
actttcaagaacttctttaatg

SEQ ID NO: 10050576 - DNA, 22 bp, Homo sapiens
atatttataagcaagcaggact

SEQ ID NO: 10050577 - DNA, 22 bp, Homo sapiens
agaaaagtgctctagtgagagc

SEQ ID NO: 10050578 - DNA, 22 bp, Homo sapiens
agaaaagtttaaatcttggcac

SEQ ID NO: 10050579 - DNA, 22 bp, Homo sapiens
actgtgcatgaaccgaaacaaa

SEQ ID NO: 10050580 - DNA, 22 bp, Homo sapiens
actgtgcacacaaaaatagatt

SEQ ID NO: 10050581 - DNA, 22 bp, Homo sapiens
ataaaatttgctactgttaaat

SEQ ID NO: 10050582 - DNA, 22 bp, Homo sapiens
ataaacaagactggccaacttt

SEQ ID NO: 10050583 - DNA, 21 bp, Homo sapiens
ataaacagcatgtgatccatg

SEQ ID NO: 10050584 - DNA, 22 bp, Homo sapiens
ataaacagcataaaatacgctt

SEQ ID NO: 10050585 - DNA, 22 bp, Homo sapiens
ataaacagtaaatgtgagcagt

SEQ ID NO: 10050586 - DNA, 22 bp, Homo sapiens
ataaacagtagagaaaggtggt

SEQ ID NO: 10050587 - DNA, 22 bp, Homo sapiens
actgtgcaatgagtaataaact

SEQ ID NO: 10050588 - DNA, 22 bp, Homo sapiens
actgtcaaaagagattatatta

SEQ ID NO: 10050589 - DNA, 22 bp, Homo sapiens
actgtcacttgcaactgtgagg

SEQ ID NO: 10050590 - DNA, 22 bp, Homo sapiens
actgtcactgtgatgttagaga

SEQ ID NO: 10050591 - DNA, 22 bp, Homo sapiens
actgtcactaactaagtctagt

SEQ ID NO: 10050592 - DNA, 22 bp, Homo sapiens
actgtagagaatctgagaaaaa

SEQ ID NO: 10050593 - DNA, 22 bp, Homo sapiens
actgtacatgtaaacattgtca

SEQ ID NO: 10050594 - DNA, 22 bp, Homo sapiens
atacattagctcatatgattaa

SEQ ID NO: 10050595 - DNA, 22 bp, Homo sapiens
atactgtaatacctaaatgaac

SEQ ID NO: 10050596 - DNA, 22 bp, Homo sapiens
atactgaattaggtaaagcata

SEQ ID NO: 10050597 - DNA, 22 bp, Homo sapiens
ataatggattcagaaccgtcaa

SEQ ID NO: 10050598 - DNA, 22 bp, Homo sapiens
acttagaaagggattctagatt

SEQ ID NO: 10050599 - DNA, 22 bp, Homo sapiens
acttagaacaggcagaattcca

SEQ ID NO: 10050600 - DNA, 22 bp, Homo sapiens
acgcctgtaatcccagcacttt

SEQ ID NO: 10050601 - DNA, 22 bp, Homo sapiens
acgatgctcaactatatgaatt

SEQ ID NO: 10050602 - DNA, 22 bp, Homo sapiens
acgatgctggattatctcaagg

SEQ ID NO: 10050603 - DNA, 22 bp, Homo sapiens
aggtggctcctcccatggctgg

SEQ ID NO: 10050604 - DNA, 22 bp, Homo sapiens
agtaaaatttctgctgaggaga

SEQ ID NO: 10050605 - DNA, 22 bp, Homo sapiens
actaggggctcaggcccaggga

SEQ ID NO: 10050606 - DNA, 22 bp, Homo sapiens
agtcaacacctggttctattac

SEQ ID NO: 10050607 - DNA, 22 bp, Homo sapiens
agtcaacatttgagatgcaatg

SEQ ID NO: 10050608 - DNA, 22 bp, Homo sapiens
agtcccagctactcaagaggct

SEQ ID NO: 10050609 - DNA, 22 bp, Homo sapiens
aggtcgagtttcggggctactt

SEQ ID NO: 10050610 - DNA, 22 bp, Homo sapiens
aggtggcatgcctgagacataa

SEQ ID NO: 10050611 - DNA, 23 bp, Homo sapiens
aggtggccaccagaatgttaagg

SEQ ID NO: 10050612 - DNA, 22 bp, Homo sapiens
aggtggccaataaatgttggag

SEQ ID NO: 10050613 - DNA, 22 bp, Homo sapiens
aggtggcatttacaccatggga

SEQ ID NO: 10050614 - DNA, 22 bp, Homo sapiens
aggtggccaagactgtttgaca

SEQ ID NO: 10050615 - DNA, 22 bp, Homo sapiens
aggtggcatttacaccatggga

SEQ ID NO: 10050616 - DNA, 22 bp, Homo sapiens
acctgccagaatgctagtcctg

SEQ ID NO: 10050617 - DNA, 22 bp, Homo sapiens
accctccccaagaggtcgtgcc

SEQ ID NO: 10050618 - DNA, 22 bp, Homo sapiens
acctctggccaagactcgtgtt

SEQ ID NO: 10050619 - DNA, 22 bp, Homo sapiens
acctcctgatgagagtaaagga

SEQ ID NO: 10050620 - DNA, 22 bp, Homo sapiens
actcctgtgggcatggcacccc

SEQ ID NO: 10050621 - DNA, 19 bp, Homo sapiens
agtcttgtatttttcaagc

SEQ ID NO: 10050622 - DNA, 22 bp, Homo sapiens
actcggggtggagagagcggtg

SEQ ID NO: 10050623 - DNA, 22 bp, Homo sapiens
actctaaaagtgaagtgtggtc

SEQ ID NO: 10050624 - DNA, 22 bp, Homo sapiens
agtcttctttcatttactcagt

SEQ ID NO: 10050625 - DNA, 22 bp, Homo sapiens
agtcttcttgatcttttcagtg

SEQ ID NO: 10050626 - DNA, 22 bp, Homo sapiens
agtcttctgtttttcagcagct

SEQ ID NO: 10050627 - DNA, 22 bp, Homo sapiens
actcttcacacttgtctccagg

SEQ ID NO: 10050628 - DNA, 22 bp, Homo sapiens
actcttcaagggcctagaggtg

SEQ ID NO: 10050629 - DNA, 22 bp, Homo sapiens
actgaggatggataggtcatat

SEQ ID NO: 10050630 - DNA, 22 bp, Homo sapiens
actgcagaggtggggtgcagag

SEQ ID NO: 10050631 - DNA, 22 bp, Homo sapiens
actgcagagcttttcagttgag

SEQ ID NO: 10050632 - DNA, 22 bp, Homo sapiens
actgcagaggtggggtgcagag

SEQ ID NO: 10050633 - DNA, 22 bp, Homo sapiens
agtgtacatgtttacagcatct

SEQ ID NO: 10050634 - DNA, 22 bp, Homo sapiens
agtgtacatcagaacatatcaa

SEQ ID NO: 10050635 - DNA, 20 bp, Homo sapiens
agtgtacagacactagaaat

SEQ ID NO: 10050636 - DNA, 22 bp, Homo sapiens
agtgtacactaaatgaatacaa

SEQ ID NO: 10050637 - DNA, 22 bp, Homo sapiens
agtgtacatagttaggaacatc

SEQ ID NO: 10050638 - DNA, 22 bp, Homo sapiens
agtggcagtggctgggcagagc

SEQ ID NO: 10050639 - DNA, 22 bp, Homo sapiens
agtggcagtggaaagcacacgg

SEQ ID NO: 10050640 - DNA, 22 bp, Homo sapiens
agtggcagtagatgagctggtt

SEQ ID NO: 10050641 - DNA, 22 bp, Homo sapiens
agtggcagtagatgagctggtt

SEQ ID NO: 10050642 - DNA, 21 bp, Homo sapiens
agtgtgtgataggcaggaaga

SEQ ID NO: 10050643 - DNA, 22 bp, Homo sapiens
agtgtttaaactgaagtgatga

SEQ ID NO: 10050644 - DNA, 22 bp, Homo sapiens
agtgtttatattatggaaatat

SEQ ID NO: 10050645 - DNA, 22 bp, Homo sapiens
agtgtttagcatgaagttcatt

SEQ ID NO: 10050646 - DNA, 22 bp, Homo sapiens
agtgtttaccccaatcagttta

SEQ ID NO: 10050647 - DNA, 22 bp, Homo sapiens
agtgtattaatgctccaggagt

SEQ ID NO: 10050648 - DNA, 22 bp, Homo sapiens
agtgtattacagaactgacatt

SEQ ID NO: 10050649 - DNA, 22 bp, Homo sapiens
aggacacacttctgaggtcttt

SEQ ID NO: 10050650 - DNA, 22 bp, Homo sapiens
aggacacagctcttcagtaaga

SEQ ID NO: 10050651 - DNA, 22 bp, Homo sapiens
aggacacagctcttcagtaaga

SEQ ID NO: 10050652 - DNA, 22 bp, Homo sapiens
acagtaaataatgcatgttgat

SEQ ID NO: 10050653 - DNA, 22 bp, Homo sapiens
acagtaaaacatttttattagg

SEQ ID NO: 10050654 - DNA, 20 bp, Homo sapiens
acagtcgcctatcaaccagg

SEQ ID NO: 10050655 - DNA, 22 bp, Homo sapiens
acagtccttgtttcggtcagat

SEQ ID NO: 10050656 - DNA, 22 bp, Homo sapiens
acagtccttgtgtggaacatta

SEQ ID NO: 10050657 - DNA, 22 bp, Homo sapiens
acagtcctagctgcaaagaagt

SEQ ID NO: 10050658 - DNA, 22 bp, Homo sapiens
acagtcctgtacaggccatatc

SEQ ID NO: 10050659 - DNA, 22 bp, Homo sapiens
acagtcctgttgtcaaagcaat

SEQ ID NO: 10050660 - DNA, 20 bp, Homo sapiens
acagtcctgcactggtgttt

SEQ ID NO: 10050661 - DNA, 22 bp, Homo sapiens
acagtcctgttgtcaaagcaat

SEQ ID NO: 10050662 - DNA, 19 bp, Homo sapiens
acagtccagctgtttgtac

SEQ ID NO: 10050663 - DNA, 22 bp, Homo sapiens
acagtcctaagataattgtctc

SEQ ID NO: 10050664 - DNA, 22 bp, Homo sapiens
acagtccagcctagtatgtata

SEQ ID NO: 10050665 - DNA, 23 bp, Homo sapiens
acagtgtctgctgcaagatatct

SEQ ID NO: 10050666 - DNA, 22 bp, Homo sapiens
acatagaacttcgatgtctttt

SEQ ID NO: 10050667 - DNA, 22 bp, Homo sapiens
acatagaacttcgatgtctttt

SEQ ID NO: 10050668 - DNA, 21 bp, Homo sapiens
acatacattatctttttaaaa

SEQ ID NO: 10050669 - DNA, 21 bp, Homo sapiens
acatacattatctttttaaaa

SEQ ID NO: 10050670 - DNA, 22 bp, Homo sapiens
acatagaagtgatgcttatcca

SEQ ID NO: 10050671 - DNA, 22 bp, Homo sapiens
acatagcataaagaatgactct

SEQ ID NO: 10050672 - DNA, 22 bp, Homo sapiens
acatagcacgtctcaatttgga

SEQ ID NO: 10050673 - DNA, 20 bp, Homo sapiens
aggcactggatttcttatat

SEQ ID NO: 10050674 - DNA, 22 bp, Homo sapiens
aggcactgggaatatgctgagg

SEQ ID NO: 10050675 - DNA, 22 bp, Homo sapiens
acagttcagacaagtgttccat

SEQ ID NO: 10050676 - DNA, 22 bp, Homo sapiens
aggaagaatgtttacatatcaa

SEQ ID NO: 10050677 - DNA, 22 bp, Homo sapiens
acaggcagggacctcttgagtt

SEQ ID NO: 10050678 - DNA, 22 bp, Homo sapiens
acagggaaggatttagtgggaa

SEQ ID NO: 10050679 - DNA, 22 bp, Homo sapiens
acagggaatggagggatcagta

SEQ ID NO: 10050680 - DNA, 21 bp, Homo sapiens
acaggcaccatgcctgtgcct

SEQ ID NO: 10050681 - DNA, 22 bp, Homo sapiens
acaggcacaggtgtgccccacc

SEQ ID NO: 10050682 - DNA, 22 bp, Homo sapiens
acaggagggacaccttcctgct

SEQ ID NO: 10050683 - DNA, 22 bp, Homo sapiens
agctggcagagcatttgtggcc

SEQ ID NO: 10050684 - DNA, 19 bp, Homo sapiens
agctggcactagaatccag

SEQ ID NO: 10050685 - DNA, 22 bp, Homo sapiens
agctggaggggccagcaggtgt

SEQ ID NO: 10050686 - DNA, 22 bp, Homo sapiens
agctgactctggcctctggtcc

SEQ ID NO: 10050687 - DNA, 22 bp, Homo sapiens
agctgactgatgaagaggcctt

SEQ ID NO: 10050688 - DNA, 22 bp, Homo sapiens
agctgacttcttgatccaatga

SEQ ID NO: 10050689 - DNA, 22 bp, Homo sapiens
acatttcgtgctctgttttgtt

SEQ ID NO: 10050690 - DNA, 22 bp, Homo sapiens
acatttcactgttcacagcagg

SEQ ID NO: 10050691 - DNA, 22 bp, Homo sapiens
acattgatatttcaaatacagg

SEQ ID NO: 10050692 - DNA, 22 bp, Homo sapiens
aggctctgttattctagagggc

SEQ ID NO: 10050693 - DNA, 22 bp, Homo sapiens
acatttcttttcatctctatat

SEQ ID NO: 10050694 - DNA, 18 bp, Homo sapiens
acatttctatgcttctgg

SEQ ID NO: 10050695 - DNA, 22 bp, Homo sapiens
acatttctcttgatgtctctat

SEQ ID NO: 10050696 - DNA, 22 bp, Homo sapiens
acatttcttgatgcctctgtga

SEQ ID NO: 10050697 - DNA, 22 bp, Homo sapiens
acatttctttctattcagtagc

SEQ ID NO: 10050698 - DNA, 22 bp, Homo sapiens
acatccagatctcagcatggct

SEQ ID NO: 10050699 - DNA, 21 bp, Homo sapiens
acatccagggtcctcactgcc

SEQ ID NO: 10050700 - DNA, 22 bp, Homo sapiens
acatccactatccttgcttgtt

SEQ ID NO: 10050701 - DNA, 22 bp, Homo sapiens
acatccaccacatgccaggctc

SEQ ID NO: 10050702 - DNA, 22 bp, Homo sapiens
acatccacatttattcagtcat

SEQ ID NO: 10050703 - DNA, 22 bp, Homo sapiens
acatcacagagcccagataaag

SEQ ID NO: 10050704 - DNA, 22 bp, Homo sapiens
acatcacagagcccagataaag

SEQ ID NO: 10050705 - DNA, 22 bp, Homo sapiens
acatcagattatgctttgctta

SEQ ID NO: 10050706 - DNA, 22 bp, Homo sapiens
acatgttcatgcatgcacaggt

SEQ ID NO: 10050707 - DNA, 22 bp, Homo sapiens
aggccagggcactgctctttag

SEQ ID NO: 10050708 - DNA, 21 bp, Homo sapiens
accagcaggagatcagaagga

SEQ ID NO: 10050709 - DNA, 22 bp, Homo sapiens
accagcagctgcgggccactgc

SEQ ID NO: 10050710 - DNA, 22 bp, Homo sapiens
accagcagctgccagagtggag

SEQ ID NO: 10050711 - DNA, 22 bp, Homo sapiens
accagcagcctagagcgttctt

SEQ ID NO: 10050712 - DNA, 22 bp, Homo sapiens
accagcagttatgaggccagga

SEQ ID NO: 10050713 - DNA, 22 bp, Homo sapiens
accagccagccacagtggctcc

SEQ ID NO: 10050714 - DNA, 22 bp, Homo sapiens
accagcaggtggcagtatgtat

SEQ ID NO: 10050715 - DNA, 22 bp, Homo sapiens
accagcagggctgggccaatgg

SEQ ID NO: 10050716 - DNA, 22 bp, Homo sapiens
agggcagcaaagtttgacctca

SEQ ID NO: 10050717 - DNA, 22 bp, Homo sapiens
accagcctggccaacatggtga

SEQ ID NO: 10050718 - DNA, 22 bp, Homo sapiens
agggagagaagttatacaagat

SEQ ID NO: 10050719 - DNA, 22 bp, Homo sapiens
acccagcctacaaagctcacct

SEQ ID NO: 10050720 - DNA, 22 bp, Homo sapiens
acccagagtgtctgtctcagtc

SEQ ID NO: 10050721 - DNA, 22 bp, Homo sapiens
acccagagccagggtcaggagc

SEQ ID NO: 10050722 - DNA, 22 bp, Homo sapiens
agggggcatcaggtcctggctc

SEQ ID NO: 10050723 - DNA, 22 bp, Homo sapiens
agggggcaggagagacctgctg

SEQ ID NO: 10050724 - DNA, 22 bp, Homo sapiens
tcctaggatctggggtgttttt

SEQ ID NO: 10050725 - DNA, 22 bp, Homo sapiens
tcctagaataatctttgactgc

SEQ ID NO: 10050726 - DNA, 22 bp, Homo sapiens
tcctagaaggatcattctagtg

SEQ ID NO: 10050727 - DNA, 22 bp, Homo sapiens
tcctagagcctccagagggaga

SEQ ID NO: 10050728 - DNA, 22 bp, Homo sapiens
tccctggctgggggctgccttg

SEQ ID NO: 10050729 - DNA, 22 bp, Homo sapiens
tcccagagatttcctctccttc

SEQ ID NO: 10050730 - DNA, 22 bp, Homo sapiens
tcccaagacctggcatccaagt

SEQ ID NO: 10050731 - DNA, 17 bp, Homo sapiens
tccattcctaaggccct

SEQ ID NO: 10050732 - DNA, 22 bp, Homo sapiens
tcccaaagctactcttctgact

SEQ ID NO: 10050733 - DNA, 22 bp, Homo sapiens
tccatttagctggcaaacaatg

SEQ ID NO: 10050734 - DNA, 22 bp, Homo sapiens
tcccagaggctccagtctctat

SEQ ID NO: 10050735 - DNA, 22 bp, Homo sapiens
tcccagccacaggtgtagccct

SEQ ID NO: 10050736 - DNA, 22 bp, Homo sapiens
tcccaggccacacttggggaac

SEQ ID NO: 10050737 - DNA, 22 bp, Homo sapiens
tcccagcctggaccctgccagt

SEQ ID NO: 10050738 - DNA, 22 bp, Homo sapiens
tccacaaggcagctcctccagg

SEQ ID NO: 10050739 - DNA, 22 bp, Homo sapiens
tcctgatggaggggtcatcttt

SEQ ID NO: 10050740 - DNA, 22 bp, Homo sapiens
tcctgagataaatctcatgtga

SEQ ID NO: 10050741 - DNA, 22 bp, Homo sapiens
tcctgaaaaattacatgttcag

SEQ ID NO: 10050742 - DNA, 22 bp, Homo sapiens
tcctgaaaataatttcacaaga

SEQ ID NO: 10050743 - DNA, 22 bp, Homo sapiens
tcctgagaatagagttgcatgt

SEQ ID NO: 10050744 - DNA, 22 bp, Homo sapiens
tcaggacatttgtcagcaggag

SEQ ID NO: 10050745 - DNA, 22 bp, Homo sapiens
tcaggagaacttccttctaccc

SEQ ID NO: 10050746 - DNA, 22 bp, Homo sapiens
tcaggacagaaggctgccaggg

SEQ ID NO: 10050747 - DNA, 22 bp, Homo sapiens
tcaggacagttccctgcaaatt

SEQ ID NO: 10050748 - DNA, 22 bp, Homo sapiens
tcagctggatgtggaagtgcta

SEQ ID NO: 10050749 - DNA, 22 bp, Homo sapiens
tcagccaggccaccttcagctt

SEQ ID NO: 10050750 - DNA, 22 bp, Homo sapiens
tcagccaggcacaatggcagct

SEQ ID NO: 10050751 - DNA, 22 bp, Homo sapiens
tcagccaggcagccccctggtc

SEQ ID NO: 10050752 - DNA, 22 bp, Homo sapiens
tcagccagctcttggactctga

SEQ ID NO: 10050753 - DNA, 22 bp, Homo sapiens
tcagccagctgtgtgcttctgc

SEQ ID NO: 10050754 - DNA, 20 bp, Homo sapiens
tcagccagctaacatgggga

SEQ ID NO: 10050755 - DNA, 22 bp, Homo sapiens
tcagccagccagctacaggctt

SEQ ID NO: 10050756 - DNA, 22 bp, Homo sapiens
tcagcatgtacttctcctccat

SEQ ID NO: 10050757 - DNA, 20 bp, Homo sapiens
tcagcatgctcctcagacat

SEQ ID NO: 10050758 - DNA, 20 bp, Homo sapiens
tcagcatgttctcctccggt

SEQ ID NO: 10050759 - DNA, 22 bp, Homo sapiens
tcagccagaaagtgattttcag

SEQ ID NO: 10050760 - DNA, 22 bp, Homo sapiens
tcagccagcatcagctaagtgc

SEQ ID NO: 10050761 - DNA, 22 bp, Homo sapiens
tcagccagcattacccctgact

SEQ ID NO: 10050762 - DNA, 22 bp, Homo sapiens
tcagccagaggcttcttggttt

SEQ ID NO: 10050763 - DNA, 22 bp, Homo sapiens
tcagccagagggggcaaaggaa

SEQ ID NO: 10050764 - DNA, 22 bp, Homo sapiens
tcagccagaggtggatgagtca

SEQ ID NO: 10050765 - DNA, 22 bp, Homo sapiens
tcagacaagttgatgtacctgg

SEQ ID NO: 10050766 - DNA, 21 bp, Homo sapiens
tcagagtgtgttacagcaagc

SEQ ID NO: 10050767 - DNA, 22 bp, Homo sapiens
tcagagtgttttactaaacaag

SEQ ID NO: 10050768 - DNA, 22 bp, Homo sapiens
tcagacaactctggaggctggc

SEQ ID NO: 10050769 - DNA, 22 bp, Homo sapiens
tcagcagggagaggagaatgca

SEQ ID NO: 10050770 - DNA, 17 bp, Homo sapiens
tcagcaggggccaagct

SEQ ID NO: 10050771 - DNA, 22 bp, Homo sapiens
tcagcaggcaggaggcatgcca

SEQ ID NO: 10050772 - DNA, 22 bp, Homo sapiens
tcactgcatcccatctccagcc

SEQ ID NO: 10050773 - DNA, 22 bp, Homo sapiens
tcactgcgcttcagcctgggtg

SEQ ID NO: 10050774 - DNA, 22 bp, Homo sapiens
tcagaaaggccacatggtgcag

SEQ ID NO: 10050775 - DNA, 22 bp, Homo sapiens
tcagaacactttctctactgac

SEQ ID NO: 10050776 - DNA, 22 bp, Homo sapiens
tcagaacaattgggaaccatta

SEQ ID NO: 10050777 - DNA, 22 bp, Homo sapiens
tcagaacagaagaaggaacacg

SEQ ID NO: 10050778 - DNA, 22 bp, Homo sapiens
tcagaaagctatatggtgtgtc

SEQ ID NO: 10050779 - DNA, 22 bp, Homo sapiens
tcagaaagaacacaggcagtag

SEQ ID NO: 10050780 - DNA, 23 bp, Homo sapiens
tcagaagtgggatacaaagctga

SEQ ID NO: 10050781 - DNA, 22 bp, Homo sapiens
tcagaagccgggcaggttttgg

SEQ ID NO: 10050782 - DNA, 22 bp, Homo sapiens
tcagaacagcacagggtgattt

SEQ ID NO: 10050783 - DNA, 22 bp, Homo sapiens
tcagaatggcccataaatagtc

SEQ ID NO: 10050784 - DNA, 22 bp, Homo sapiens
tcagaataaacatgggcatggg

SEQ ID NO: 10050785 - DNA, 20 bp, Homo sapiens
tcagaagtttcctggagcat

SEQ ID NO: 10050786 - DNA, 22 bp, Homo sapiens
tcaactaaggcacaatctctaa

SEQ ID NO: 10050787 - DNA, 22 bp, Homo sapiens
tcaagaaaatgcctgctggtgt

SEQ ID NO: 10050788 - DNA, 22 bp, Homo sapiens
tcaagaaactgtgctacagagt

SEQ ID NO: 10050789 - DNA, 22 bp, Homo sapiens
tcacagtcggtgacttcttgct

SEQ ID NO: 10050790 - DNA, 22 bp, Homo sapiens
tcaagaactgtgaagagtctga

SEQ ID NO: 10050791 - DNA, 22 bp, Homo sapiens
tcaacagacatttttaagcact

SEQ ID NO: 10050792 - DNA, 22 bp, Homo sapiens
tcaaatgaggctgatgaatgtg

SEQ ID NO: 10050793 - DNA, 22 bp, Homo sapiens
tcaaatgaggctgatgaatgtg

SEQ ID NO: 10050794 - DNA, 22 bp, Homo sapiens
tcaaatgagtgactcacacagg

SEQ ID NO: 10050795 - DNA, 22 bp, Homo sapiens
tcaaatgagtgactcacacagg

SEQ ID NO: 10050796 - DNA, 22 bp, Homo sapiens
tcaacaatgggtctgtaatgga

SEQ ID NO: 10050797 - DNA, 22 bp, Homo sapiens
tcaacaataggatatagcaggt

SEQ ID NO: 10050798 - DNA, 22 bp, Homo sapiens
tcaacaattgcatgttgatgtt

SEQ ID NO: 10050799 - DNA, 22 bp, Homo sapiens
tcatttttagcgcgcaaaagtt

SEQ ID NO: 10050800 - DNA, 22 bp, Homo sapiens
tcatttttctcttacacgtaga

SEQ ID NO: 10050801 - DNA, 22 bp, Homo sapiens
tcatttttctcttacacgtaga

SEQ ID NO: 10050802 - DNA, 22 bp, Homo sapiens
tccaaagtaatttcacttctgt

SEQ ID NO: 10050803 - DNA, 22 bp, Homo sapiens
tccaaagtaatttcacttctgt

SEQ ID NO: 10050804 - DNA, 19 bp, Homo sapiens
tccaaaggacccacctcca

SEQ ID NO: 10050805 - DNA, 22 bp, Homo sapiens
tccaactttctcctccggcttg

SEQ ID NO: 10050806 - DNA, 22 bp, Homo sapiens
tccaagtttcttctgcacaaca

SEQ ID NO: 10050807 - DNA, 22 bp, Homo sapiens
tccaagttctaggaactgctgc

SEQ ID NO: 10050808 - DNA, 20 bp, Homo sapiens
tccaagttataaagtgccaa

SEQ ID NO: 10050809 - DNA, 22 bp, Homo sapiens
tcatttaataatttttgagtag

SEQ ID NO: 10050810 - DNA, 22 bp, Homo sapiens
tcatttataaggatgcaattaa

SEQ ID NO: 10050811 - DNA, 22 bp, Homo sapiens
tcattgtaattatctgtggtat

SEQ ID NO: 10050812 - DNA, 22 bp, Homo sapiens
tcatgcatctgggctggctggt

SEQ ID NO: 10050813 - DNA, 22 bp, Homo sapiens
tcatttatattgtattctgtag

SEQ ID NO: 10050814 - DNA, 22 bp, Homo sapiens
tcatttctcccggccaaaaact

SEQ ID NO: 10050815 - DNA, 23 bp, Homo sapiens
tcagtcctgtaggggctccaggt

SEQ ID NO: 10050816 - DNA, 21 bp, Homo sapiens
tcagtcctgttagcctttggg

SEQ ID NO: 10050817 - DNA, 22 bp, Homo sapiens
tcagtcctgatgacaggcccaa

SEQ ID NO: 10050818 - DNA, 22 bp, Homo sapiens
tcagtcctacacgctcagggac

SEQ ID NO: 10050819 - DNA, 22 bp, Homo sapiens
tcagtattcctggaaatacaag

SEQ ID NO: 10050820 - DNA, 22 bp, Homo sapiens
tcagtcctccacacaggcaccc

SEQ ID NO: 10050821 - DNA, 23 bp, Homo sapiens
tcataaatattagcacagtagga

SEQ ID NO: 10050822 - DNA, 22 bp, Homo sapiens
tcataaagttctaagaattgta

SEQ ID NO: 10050823 - DNA, 22 bp, Homo sapiens
tcataaagttatcaccaaatcc

SEQ ID NO: 10050824 - DNA, 22 bp, Homo sapiens
tcataaagttacccaaatttta

SEQ ID NO: 10050825 - DNA, 22 bp, Homo sapiens
tcagttaagaggccacggcagt

SEQ ID NO: 10050826 - DNA, 22 bp, Homo sapiens
tcataaattagctgtctttgaa

SEQ ID NO: 10050827 - DNA, 22 bp, Homo sapiens
tcatacatcttgtatatctatc

SEQ ID NO: 10050828 - DNA, 22 bp, Homo sapiens
tcatctttgtatccctaacaca

SEQ ID NO: 10050829 - DNA, 22 bp, Homo sapiens
tcagtatcaggctggaattaag

SEQ ID NO: 10050830 - DNA, 22 bp, Homo sapiens
tatgaaatttaaacacagatca

SEQ ID NO: 10050831 - DNA, 22 bp, Homo sapiens
tatccaaaggaacaatcacagc

SEQ ID NO: 10050832 - DNA, 22 bp, Homo sapiens
tatcatttgttattattagtgg

SEQ ID NO: 10050833 - DNA, 22 bp, Homo sapiens
tatcatttaacagaatcattgc

SEQ ID NO: 10050834 - DNA, 23 bp, Homo sapiens
tatctttttcaatgttggaaata

SEQ ID NO: 10050835 - DNA, 22 bp, Homo sapiens
tatgaaaaggtggccaatgtag

SEQ ID NO: 10050836 - DNA, 22 bp, Homo sapiens
tatcttttgagttctcaagatg

SEQ ID NO: 10050837 - DNA, 18 bp, Homo sapiens
tatcttttccagtggtat

SEQ ID NO: 10050838 - DNA, 22 bp, Homo sapiens
tatgaaaatttagctgaagcat

SEQ ID NO: 10050839 - DNA, 22 bp, Homo sapiens
tatgaaaaggtggccaatgtag

SEQ ID NO: 10050840 - DNA, 22 bp, Homo sapiens
tatgaaagaatctcagagcaca

SEQ ID NO: 10050841 - DNA, 22 bp, Homo sapiens
tatgaaagaatctcagagcaca

SEQ ID NO: 10050842 - DNA, 22 bp, Homo sapiens
tatcagaaatcaacacacagtg

SEQ ID NO: 10050843 - DNA, 22 bp, Homo sapiens
tatcagaaactctggggcaggg

SEQ ID NO: 10050844 - DNA, 22 bp, Homo sapiens
tatcagaaatcaacacacagtg

SEQ ID NO: 10050845 - DNA, 22 bp, Homo sapiens
tatcagcgtgcaaatctttgga

SEQ ID NO: 10050846 - DNA, 22 bp, Homo sapiens
tatcagaatgcagccatgtgca

SEQ ID NO: 10050847 - DNA, 22 bp, Homo sapiens
tatcagaaggcacatggagtct

SEQ ID NO: 10050848 - DNA, 21 bp, Homo sapiens
tatcagaagagaaagaatgat

SEQ ID NO: 10050849 - DNA, 22 bp, Homo sapiens
tatcagaagacttacagtatcg

SEQ ID NO: 10050850 - DNA, 22 bp, Homo sapiens
tataaaattctcagtttggggt

SEQ ID NO: 10050851 - DNA, 22 bp, Homo sapiens
tataaaatggcatcagctccaa

SEQ ID NO: 10050852 - DNA, 22 bp, Homo sapiens
tataaaacagaaagcactacct

SEQ ID NO: 10050853 - DNA, 18 bp, Homo sapiens
tataaacacacttaggtt

SEQ ID NO: 10050854 - DNA, 22 bp, Homo sapiens
tataaagctgactcatgaaact

SEQ ID NO: 10050855 - DNA, 22 bp, Homo sapiens
tattaaattatggatttaggag

SEQ ID NO: 10050856 - DNA, 22 bp, Homo sapiens
tattaacatgaactgacttttc

SEQ ID NO: 10050857 - DNA, 22 bp, Homo sapiens
tattaacattttatgaaaataa

SEQ ID NO: 10050858 - DNA, 22 bp, Homo sapiens
tatggaaataattagacaagtg

SEQ ID NO: 10050859 - DNA, 22 bp, Homo sapiens
tatggaaataattagacaagtg

SEQ ID NO: 10050860 - DNA, 22 bp, Homo sapiens
tatggaaactaattcatttttc

SEQ ID NO: 10050861 - DNA, 22 bp, Homo sapiens
tatggaaactaattcatttttc

SEQ ID NO: 10050862 - DNA, 22 bp, Homo sapiens
tatggaaaaatgtatcttgtca

SEQ ID NO: 10050863 - DNA, 22 bp, Homo sapiens
tatggaaagtgttttcttctgt

SEQ ID NO: 10050864 - DNA, 22 bp, Homo sapiens
tatggaaagggagtttaatttg

SEQ ID NO: 10050865 - DNA, 22 bp, Homo sapiens
tatggaaagggagtttaatttg

SEQ ID NO: 10050866 - DNA, 22 bp, Homo sapiens
tatgctttaacattaaacaaca

SEQ ID NO: 10050867 - DNA, 22 bp, Homo sapiens
tatgctttaaccctcttatatt

SEQ ID NO: 10050868 - DNA, 22 bp, Homo sapiens
tatgctttgcaattggaaaagg

SEQ ID NO: 10050869 - DNA, 22 bp, Homo sapiens
tatgtaaagtagatggcaggta

SEQ ID NO: 10050870 - DNA, 22 bp, Homo sapiens
tcaaatgaagacagttgacttg

SEQ ID NO: 10050871 - DNA, 22 bp, Homo sapiens
tcaaatcagcaagcagcttccc

SEQ ID NO: 10050872 - DNA, 22 bp, Homo sapiens
tcaaataccagcaatttcatgt

SEQ ID NO: 10050873 - DNA, 22 bp, Homo sapiens
tcaaagtattttaactgtatcc

SEQ ID NO: 10050874 - DNA, 22 bp, Homo sapiens
tcaaataaggagtcatgaccat

SEQ ID NO: 10050875 - DNA, 22 bp, Homo sapiens
tcaaataatgccattcatcatc

SEQ ID NO: 10050876 - DNA, 22 bp, Homo sapiens
tcaaaggcttgtggttctggga

SEQ ID NO: 10050877 - DNA, 22 bp, Homo sapiens
tcaaaggctgcttgtcttctgg

SEQ ID NO: 10050878 - DNA, 22 bp, Homo sapiens
tcaaaggcggtccaggaataaa

SEQ ID NO: 10050879 - DNA, 19 bp, Homo sapiens
tcaaaggcttttaggagac

SEQ ID NO: 10050880 - DNA, 22 bp, Homo sapiens
tcaaagatgatgctgaagttat

SEQ ID NO: 10050881 - DNA, 22 bp, Homo sapiens
tcaaagatagatgttgagaaat

SEQ ID NO: 10050882 - DNA, 22 bp, Homo sapiens
tcaaagatgataggaaatcata

SEQ ID NO: 10050883 - DNA, 22 bp, Homo sapiens
tcaaagagctctatcttcaaaa

SEQ ID NO: 10050884 - DNA, 22 bp, Homo sapiens
tatttcttgttattctcgttga

SEQ ID NO: 10050885 - DNA, 22 bp, Homo sapiens
tatttgcaggacatagatatgg

SEQ ID NO: 10050886 - DNA, 22 bp, Homo sapiens
tatttgatggttctaaaacagc

SEQ ID NO: 10050887 - DNA, 22 bp, Homo sapiens
tattgtattaaggattcaagta

SEQ ID NO: 10050888 - DNA, 22 bp, Homo sapiens
tattacaatttacattgcactt

SEQ ID NO: 10050889 - DNA, 22 bp, Homo sapiens
tatttaactggaaacacaatga

SEQ ID NO: 10050890 - DNA, 22 bp, Homo sapiens
tatttaaaatagtgctccagca

SEQ ID NO: 10050891 - DNA, 22 bp, Homo sapiens
tagagaaaagcagggatcagga

SEQ ID NO: 10050892 - DNA, 22 bp, Homo sapiens
tagagacaccagtaccattctg

SEQ ID NO: 10050893 - DNA, 22 bp, Homo sapiens
tagagacagaaagtagaatggt

SEQ ID NO: 10050894 - DNA, 22 bp, Homo sapiens
tagaagaacatgtcaaactata

SEQ ID NO: 10050895 - DNA, 22 bp, Homo sapiens
tagaagaacatgtcaaactata

SEQ ID NO: 10050896 - DNA, 22 bp, Homo sapiens
tagaagaaaagcacttagagat

SEQ ID NO: 10050897 - DNA, 22 bp, Homo sapiens
tagctggcttatataaaagggc

SEQ ID NO: 10050898 - DNA, 19 bp, Homo sapiens
tagcagctgccaaaggaga

SEQ ID NO: 10050899 - DNA, 22 bp, Homo sapiens
tagatgaaggctgagcacctgt

SEQ ID NO: 10050900 - DNA, 22 bp, Homo sapiens
tagatgaacagaaagccactgt

SEQ ID NO: 10050901 - DNA, 22 bp, Homo sapiens
tagatgaagcaacatgtgtaat

SEQ ID NO: 10050902 - DNA, 22 bp, Homo sapiens
tagatgaaaggtctagcacagt

SEQ ID NO: 10050903 - DNA, 22 bp, Homo sapiens
tagtttcatctccaccctgccc

SEQ ID NO: 10050904 - DNA, 22 bp, Homo sapiens
tagtttcatatgcaaaatagta

SEQ ID NO: 10050905 - DNA, 22 bp, Homo sapiens
tagttctataagcagatagagt

SEQ ID NO: 10050906 - DNA, 22 bp, Homo sapiens
tagtttaatggtcaactaatga

SEQ ID NO: 10050907 - DNA, 22 bp, Homo sapiens
tagggggctttgctgcttgaca

SEQ ID NO: 10050908 - DNA, 22 bp, Homo sapiens
tagggggctgtcctgtgcatta

SEQ ID NO: 10050909 - DNA, 21 bp, Homo sapiens
tagggggcagtgggatgctta

SEQ ID NO: 10050910 - DNA, 22 bp, Homo sapiens
taaatgtttagtcttatttggg

SEQ ID NO: 10050911 - DNA, 22 bp, Homo sapiens
taaatgctcaataaatgttgct

SEQ ID NO: 10050912 - DNA, 22 bp, Homo sapiens
taacatcctacactgttgtctt

SEQ ID NO: 10050913 - DNA, 22 bp, Homo sapiens
taacatccacattagatgattc

SEQ ID NO: 10050914 - DNA, 22 bp, Homo sapiens
taacataacttttccttgaccc

SEQ ID NO: 10050915 - DNA, 22 bp, Homo sapiens
taagactgtgagctcagagact

SEQ ID NO: 10050916 - DNA, 23 bp, Homo sapiens
taaagcaaagtcaagtgcactcc

SEQ ID NO: 10050917 - DNA, 22 bp, Homo sapiens
taaagcaaggaatagagtagtc

SEQ ID NO: 10050918 - DNA, 22 bp, Homo sapiens
taaagacatggtgtaggtgaac

SEQ ID NO: 10050919 - DNA, 22 bp, Homo sapiens
taaagataagacatcaactgag

SEQ ID NO: 10050920 - DNA, 22 bp, Homo sapiens
taaatgatttatgtatgtgaaa

SEQ ID NO: 10050921 - DNA, 22 bp, Homo sapiens
taaagcacgtctatttaatgat

SEQ ID NO: 10050922 - DNA, 22 bp, Homo sapiens
taaagacataggatcagggaga

SEQ ID NO: 10050923 - DNA, 22 bp, Homo sapiens
taaagacatggtgtaggtgaac

SEQ ID NO: 10050924 - DNA, 22 bp, Homo sapiens
taaagacatgcaaagtctaatt

SEQ ID NO: 10050925 - DNA, 20 bp, Homo sapiens
taaagacataagctactatc

SEQ ID NO: 10050926 - DNA, 23 bp, Homo sapiens
taaagacagccttcaggattctg

SEQ ID NO: 10050927 - DNA, 22 bp, Homo sapiens
taaagacagatggaccagccat

SEQ ID NO: 10050928 - DNA, 22 bp, Homo sapiens
taaagacactggttttaatcat

SEQ ID NO: 10050929 - DNA, 22 bp, Homo sapiens
taaaaggaggttgaagctgtca

SEQ ID NO: 10050930 - DNA, 22 bp, Homo sapiens
taaaactgcttggtatggtcta

SEQ ID NO: 10050931 - DNA, 22 bp, Homo sapiens
taaaactgaatacatactgagg

SEQ ID NO: 10050932 - DNA, 22 bp, Homo sapiens
taaaagacatataactgtagga

SEQ ID NO: 10050933 - DNA, 22 bp, Homo sapiens
taaaagaccacaaggtggtaat

SEQ ID NO: 10050934 - DNA, 22 bp, Homo sapiens
taaaagaccctctagagtccca

SEQ ID NO: 10050935 - DNA, 22 bp, Homo sapiens
gtgttctgggatgattgtagtg

SEQ ID NO: 10050936 - DNA, 22 bp, Homo sapiens
gtgttctgcagaccagcatcat

SEQ ID NO: 10050937 - DNA, 21 bp, Homo sapiens
gtgctgggacacagccaggct

SEQ ID NO: 10050938 - DNA, 17 bp, Homo sapiens
gtgctggcctggggctc

SEQ ID NO: 10050939 - DNA, 18 bp, Homo sapiens
gttaacaattactaacgc

SEQ ID NO: 10050940 - DNA, 22 bp, Homo sapiens
gttaaataacctcatgtccgtt

SEQ ID NO: 10050941 - DNA, 22 bp, Homo sapiens
gtgtttattttcatagttggcc

SEQ ID NO: 10050942 - DNA, 22 bp, Homo sapiens
gtgtttatgtttgtgtagggga

SEQ ID NO: 10050943 - DNA, 22 bp, Homo sapiens
gtgtttatttagagtaggccat

SEQ ID NO: 10050944 - DNA, 22 bp, Homo sapiens
gtgtttataggagtgaatgctg

SEQ ID NO: 10050945 - DNA, 22 bp, Homo sapiens
gtgtttatgagtgaccttgtct

SEQ ID NO: 10050946 - DNA, 22 bp, Homo sapiens
gtgtttataggagtgaatgctg

SEQ ID NO: 10050947 - DNA, 22 bp, Homo sapiens
gtgtttatacagcaaagagcat

SEQ ID NO: 10050948 - DNA, 22 bp, Homo sapiens
gtgtttatacagcaaagagcat

SEQ ID NO: 10050949 - DNA, 22 bp, Homo sapiens
gttataaatgactgcaaaagtt

SEQ ID NO: 10050950 - DNA, 22 bp, Homo sapiens
gttatattcaaaatgaggctgt

SEQ ID NO: 10050951 - DNA, 22 bp, Homo sapiens
gttatattgccaagtatattgt

SEQ ID NO: 10050952 - DNA, 22 bp, Homo sapiens
gttatcatgcttcatcatcact

SEQ ID NO: 10050953 - DNA, 22 bp, Homo sapiens
gttatattggcagaagagaaga

SEQ ID NO: 10050954 - DNA, 22 bp, Homo sapiens
gttatcttccctttgatgattt

SEQ ID NO: 10050955 - DNA, 22 bp, Homo sapiens
gttatcttctatttctcatact

SEQ ID NO: 10050956 - DNA, 22 bp, Homo sapiens
gttctgcttccttgcttgcgca

SEQ ID NO: 10050957 - DNA, 22 bp, Homo sapiens
gtttgaaaaaagcagtatgtaa

SEQ ID NO: 10050958 - DNA, 22 bp, Homo sapiens
gtttgtgtaacatgatgatgat

SEQ ID NO: 10050959 - DNA, 22 bp, Homo sapiens
gtttgcatgtgtacttaattgg

SEQ ID NO: 10050960 - DNA, 22 bp, Homo sapiens
gtttgcatgtattaagtcaata

SEQ ID NO: 10050961 - DNA, 22 bp, Homo sapiens
gtttgtttatacaaaagatcct

SEQ ID NO: 10050962 - DNA, 21 bp, Homo sapiens
gtttgcatgaacaagtcagcc

SEQ ID NO: 10050963 - DNA, 22 bp, Homo sapiens
gtttgcatatctgtgaaatgga

SEQ ID NO: 10050964 - DNA, 22 bp, Homo sapiens
gtttgaaagttcaacaggaaaa

SEQ ID NO: 10050965 - DNA, 20 bp, Homo sapiens
gtttgaaatgattggttggt

SEQ ID NO: 10050966 - DNA, 22 bp, Homo sapiens
gtttgaaagaccaattagattt

SEQ ID NO: 10050967 - DNA, 22 bp, Homo sapiens
gtttgaaacatgcacctggagg

SEQ ID NO: 10050968 - DNA, 22 bp, Homo sapiens
gtttatatgtgtgccactctta

SEQ ID NO: 10050969 - DNA, 22 bp, Homo sapiens
gtttatattcaacggagtatct

SEQ ID NO: 10050970 - DNA, 22 bp, Homo sapiens
gtttatcattattattagcaac

SEQ ID NO: 10050971 - DNA, 22 bp, Homo sapiens
gtttatcacaataaataattct

SEQ ID NO: 10050972 - DNA, 19 bp, Homo sapiens
gttcttttcacctctgtgc

SEQ ID NO: 10050973 - DNA, 22 bp, Homo sapiens
gttgaaaatacagattcctagg

SEQ ID NO: 10050974 - DNA, 22 bp, Homo sapiens
gttctttaggggcccaatttcc

SEQ ID NO: 10050975 - DNA, 22 bp, Homo sapiens
gttctttaagtggagaaggaaa

SEQ ID NO: 10050976 - DNA, 22 bp, Homo sapiens
gttctttaacctagtctcattt

SEQ ID NO: 10050977 - DNA, 21 bp, Homo sapiens
gttcttcctgactagagtagt

SEQ ID NO: 10050978 - DNA, 22 bp, Homo sapiens
gttgaaaatgactttataccat

SEQ ID NO: 10050979 - DNA, 22 bp, Homo sapiens
taccacagtttatctattcagc

SEQ ID NO: 10050980 - DNA, 22 bp, Homo sapiens
tactctaaaaagaagcagatct

SEQ ID NO: 10050981 - DNA, 22 bp, Homo sapiens
tactcctgctgatcctgccagc

SEQ ID NO: 10050982 - DNA, 22 bp, Homo sapiens
tactgtgtgcccagccgagctg

SEQ ID NO: 10050983 - DNA, 22 bp, Homo sapiens
tactgtgttgtgctgaaaggga

SEQ ID NO: 10050984 - DNA, 22 bp, Homo sapiens
tactgtgtcttaggatgtggaa

SEQ ID NO: 10050985 - DNA, 22 bp, Homo sapiens
tactgtactgtcttttttgctg

SEQ ID NO: 10050986 - DNA, 22 bp, Homo sapiens
tactgtactcaacatgtgagtt

SEQ ID NO: 10050987 - DNA, 22 bp, Homo sapiens
tactgtactgcagttctgcaaa

SEQ ID NO: 10050988 - DNA, 22 bp, Homo sapiens
tactgtacattccgtttgttgc

SEQ ID NO: 10050989 - DNA, 22 bp, Homo sapiens
tacttaatgccactgaattgta

SEQ ID NO: 10050990 - DNA, 22 bp, Homo sapiens
tacttaaataattgctgctatt

SEQ ID NO: 10050991 - DNA, 22 bp, Homo sapiens
tacttaaataattgctgctatt

SEQ ID NO: 10050992 - DNA, 22 bp, Homo sapiens
tacagagatactctagatcaaa

SEQ ID NO: 10050993 - DNA, 22 bp, Homo sapiens
tacagagatttattgctaaggc

SEQ ID NO: 10050994 - DNA, 22 bp, Homo sapiens
tacatgctcagtaactttcagt

SEQ ID NO: 10050995 - DNA, 22 bp, Homo sapiens
tacatgcttctatatgtgaagt

SEQ ID NO: 10050996 - DNA, 22 bp, Homo sapiens
tacatgcttaaaatgcaatgtt

SEQ ID NO: 10050997 - DNA, 22 bp, Homo sapiens
tacatgctccactttctcctgt

SEQ ID NO: 10050998 - DNA, 22 bp, Homo sapiens
tacatgctccttatgagaatct

SEQ ID NO: 10050999 - DNA, 22 bp, Homo sapiens
tacatgctggtgactgtagaca

SEQ ID NO: 10051000 - DNA, 20 bp, Homo sapiens
taccaacagcaggaagcata

SEQ ID NO: 10051001 - DNA, 22 bp, Homo sapiens
tacagtgtgacatttctacaaa

SEQ ID NO: 10051002 - DNA, 22 bp, Homo sapiens
tacatgaatgtttcaatattgt

SEQ ID NO: 10051003 - DNA, 22 bp, Homo sapiens
taaggacattagaaatgatgct

SEQ ID NO: 10051004 - DNA, 22 bp, Homo sapiens
taaggacattggttttgagtaa

SEQ ID NO: 10051005 - DNA, 22 bp, Homo sapiens
taaggacaatttgtcgcttgca

SEQ ID NO: 10051006 - DNA, 22 bp, Homo sapiens
taaggacaatcaggttagtagc

SEQ ID NO: 10051007 - DNA, 22 bp, Homo sapiens
taaggaaaatggacatcaaaca

SEQ ID NO: 10051008 - DNA, 22 bp, Homo sapiens
taagctcactgtaagaactgat

SEQ ID NO: 10051009 - DNA, 22 bp, Homo sapiens
taagccactgagatttggggtt

SEQ ID NO: 10051010 - DNA, 22 bp, Homo sapiens
taaggaaagtgccatgatttct

SEQ ID NO: 10051011 - DNA, 22 bp, Homo sapiens
taatttatgatgcaaagaaaag

SEQ ID NO: 10051012 - DNA, 22 bp, Homo sapiens
taatatatttctgctaagctca

SEQ ID NO: 10051013 - DNA, 22 bp, Homo sapiens
tacagaatgtgtatcattacca

SEQ ID NO: 10051014 - DNA, 22 bp, Homo sapiens
tacagaatgttatgaagcatag

SEQ ID NO: 10051015 - DNA, 22 bp, Homo sapiens
tacacagtaaatggtaaataca

SEQ ID NO: 10051016 - DNA, 22 bp, Homo sapiens
tacacagaaattgtgtagggat

SEQ ID NO: 10051017 - DNA, 22 bp, Homo sapiens
tacacagaacctggtgtacagt

SEQ ID NO: 10051018 - DNA, 22 bp, Homo sapiens
tacacagtagagtataatgcgt

SEQ ID NO: 10051019 - DNA, 22 bp, Homo sapiens
tacacacagaggccatgggatt

SEQ ID NO: 10051020 - DNA, 22 bp, Homo sapiens
tacacacatgcatttgccttat

SEQ ID NO: 10051021 - DNA, 22 bp, Homo sapiens
tacaacgtgggactttgtttct

SEQ ID NO: 10051022 - DNA, 22 bp, Homo sapiens
tacaagaaatttctgcatatat

SEQ ID NO: 10051023 - DNA, 22 bp, Homo sapiens
tacaagaaactacatgaatgca

SEQ ID NO: 10051024 - DNA, 22 bp, Homo sapiens
tacaagaaagtccagtgggttt

SEQ ID NO: 10051025 - DNA, 22 bp, Homo sapiens
tacaagaaggatggagcccact

SEQ ID NO: 10051026 - DNA, 22 bp, Homo sapiens
tacaagaagaggcagagctgga

SEQ ID NO: 10051027 - DNA, 22 bp, Homo sapiens
tacaagaaggaaaactagcaat

SEQ ID NO: 10051028 - DNA, 22 bp, Homo sapiens
tacaagaatgtcttaaaagctc

SEQ ID NO: 10051029 - DNA, 22 bp, Homo sapiens
tacaagaatgtcttaaaagctc

SEQ ID NO: 10051030 - DNA, 20 bp, Homo sapiens
tacaagaatccccagttgtc

SEQ ID NO: 10051031 - DNA, 22 bp, Homo sapiens
tacaagaatttctttctggttg

SEQ ID NO: 10051032 - DNA, 22 bp, Homo sapiens
gggaggttgaggctgcagtgag

SEQ ID NO: 10051033 - DNA, 22 bp, Homo sapiens
gggagcgggactgcgcaggctt

SEQ ID NO: 10051034 - DNA, 22 bp, Homo sapiens
gggagtggattatgtggaccca

SEQ ID NO: 10051035 - DNA, 22 bp, Homo sapiens
gggctcagctccttccttccta

SEQ ID NO: 10051036 - DNA, 22 bp, Homo sapiens
gggctcagaggagtggcctggg

SEQ ID NO: 10051037 - DNA, 22 bp, Homo sapiens
gggccccaaaatgccaggctct

SEQ ID NO: 10051038 - DNA, 22 bp, Homo sapiens
gggccggagctgggtcccgcgc

SEQ ID NO: 10051039 - DNA, 22 bp, Homo sapiens
gggccctggggatgtggacgcg

SEQ ID NO: 10051040 - DNA, 22 bp, Homo sapiens
ggctgcaggttggttggcagct

SEQ ID NO: 10051041 - DNA, 21 bp, Homo sapiens
ggctgcagggagccctggggt

SEQ ID NO: 10051042 - DNA, 22 bp, Homo sapiens
ggctgtgggccagctagaccct

SEQ ID NO: 10051043 - DNA, 22 bp, Homo sapiens
ggctgtggccagcggggctgag

SEQ ID NO: 10051044 - DNA, 22 bp, Homo sapiens
ggctgtgggtgtgacaggcctc

SEQ ID NO: 10051045 - DNA, 22 bp, Homo sapiens
gggagccatgctggtcttcttt

SEQ ID NO: 10051046 - DNA, 23 bp, Homo sapiens
gggagccatgggtggtcatggag

SEQ ID NO: 10051047 - DNA, 22 bp, Homo sapiens
ggccacagtgggaaatcctggg

SEQ ID NO: 10051048 - DNA, 22 bp, Homo sapiens
ggctctctccttggctttcaga

SEQ ID NO: 10051049 - DNA, 22 bp, Homo sapiens
ggctctctgaggaaacccttcc

SEQ ID NO: 10051050 - DNA, 22 bp, Homo sapiens
ggctctgcagagggcccagctt

SEQ ID NO: 10051051 - DNA, 22 bp, Homo sapiens
ggcctctggcaggcaggccctc

SEQ ID NO: 10051052 - DNA, 22 bp, Homo sapiens
ggcagccatggacactggctag

SEQ ID NO: 10051053 - DNA, 22 bp, Homo sapiens
ggcagcagaactggccctgtat

SEQ ID NO: 10051054 - DNA, 22 bp, Homo sapiens
ggcagcactgcagcttgttggg

SEQ ID NO: 10051055 - DNA, 22 bp, Homo sapiens
ggcacgtgcctaaggagcaggc

SEQ ID NO: 10051056 - DNA, 18 bp, Homo sapiens
ggcagtgcagtctcaggg

SEQ ID NO: 10051057 - DNA, 22 bp, Homo sapiens
ggcagccttgagggaggcctgg

SEQ ID NO: 10051058 - DNA, 22 bp, Homo sapiens
ggcagcctcaggttttctttga

SEQ ID NO: 10051059 - DNA, 22 bp, Homo sapiens
gtagtcttggattttaaaaagt

SEQ ID NO: 10051060 - DNA, 22 bp, Homo sapiens
gtcaacaaagaaaattgttaat

SEQ ID NO: 10051061 - DNA, 22 bp, Homo sapiens
gtcaaacatagggactttgtgg

SEQ ID NO: 10051062 - DNA, 22 bp, Homo sapiens
gtcaaacagcctcctgttctaa

SEQ ID NO: 10051063 - DNA, 22 bp, Homo sapiens
gtcaaacaaattaacatatcca

SEQ ID NO: 10051064 - DNA, 22 bp, Homo sapiens
gtatttttaggtaaggaaagta

SEQ ID NO: 10051065 - DNA, 22 bp, Homo sapiens
gtataactgctaccacctgatg

SEQ ID NO: 10051066 - DNA, 19 bp, Homo sapiens
gtataacttacaccagcaa

SEQ ID NO: 10051067 - DNA, 22 bp, Homo sapiens
gtataagcccattctcagagac

SEQ ID NO: 10051068 - DNA, 19 bp, Homo sapiens
gtcctgcaactggctctcc

SEQ ID NO: 10051069 - DNA, 22 bp, Homo sapiens
gtcgtggagctcacagtgtgcc

SEQ ID NO: 10051070 - DNA, 18 bp, Homo sapiens
gtcactgtgtttctgagc

SEQ ID NO: 10051071 - DNA, 22 bp, Homo sapiens
gtcagacaggaatgttgcaagt

SEQ ID NO: 10051072 - DNA, 22 bp, Homo sapiens
gtcagaaaaagcaaggctgggc

SEQ ID NO: 10051073 - DNA, 22 bp, Homo sapiens
gtcactggaattacaggcatgc

SEQ ID NO: 10051074 - DNA, 22 bp, Homo sapiens
gtccagccaggcctgtctctgg

SEQ ID NO: 10051075 - DNA, 20 bp, Homo sapiens
gtctacacgggcagtgtaga

SEQ ID NO: 10051076 - DNA, 20 bp, Homo sapiens
gtctttatgttttatgacct

SEQ ID NO: 10051077 - DNA, 22 bp, Homo sapiens
gtctttatggtatgaaaactga

SEQ ID NO: 10051078 - DNA, 23 bp, Homo sapiens
gtctttatagtggggcactttgt

SEQ ID NO: 10051079 - DNA, 22 bp, Homo sapiens
gtctttatatttactaaagaat

SEQ ID NO: 10051080 - DNA, 22 bp, Homo sapiens
gtctttatctttgaaattagtc

SEQ ID NO: 10051081 - DNA, 22 bp, Homo sapiens
gtgagctgggtgaatggtaggg

SEQ ID NO: 10051082 - DNA, 22 bp, Homo sapiens
gtgagctggaatagtggagaaa

SEQ ID NO: 10051083 - DNA, 22 bp, Homo sapiens
gtgagctgttttggacccatct

SEQ ID NO: 10051084 - DNA, 22 bp, Homo sapiens
gtctttattacaaatccttttc

SEQ ID NO: 10051085 - DNA, 16 bp, Homo sapiens
gtctttattcacttag

SEQ ID NO: 10051086 - DNA, 22 bp, Homo sapiens
gtctttatttgagattgtcatt

SEQ ID NO: 10051087 - DNA, 22 bp, Homo sapiens
gtctttggatgtaagataaagt

SEQ ID NO: 10051088 - DNA, 22 bp, Homo sapiens
gtgagcagggcaggactgggga

SEQ ID NO: 10051089 - DNA, 22 bp, Homo sapiens
gtcttttttacaccttacatca

SEQ ID NO: 10051090 - DNA, 22 bp, Homo sapiens
gtgcagggcagccgaatgggct

SEQ ID NO: 10051091 - DNA, 17 bp, Homo sapiens
gtgcagggatgaaggat

SEQ ID NO: 10051092 - DNA, 22 bp, Homo sapiens
gtgcagggagcccagaaggtcc

SEQ ID NO: 10051093 - DNA, 18 bp, Homo sapiens
gtgccaggaggcgcagcc

SEQ ID NO: 10051094 - DNA, 22 bp, Homo sapiens
gtgctgcagggcctcctgcacc

SEQ ID NO: 10051095 - DNA, 22 bp, Homo sapiens
gtgctgcagagtctcgtgccgc

SEQ ID NO: 10051096 - DNA, 22 bp, Homo sapiens
gtgctgccggcatagcagtgaa

SEQ ID NO: 10051097 - DNA, 22 bp, Homo sapiens
gtgctgcctccatatccgtcag

SEQ ID NO: 10051098 - DNA, 22 bp, Homo sapiens
gtgctgcctgccagcttctggg

SEQ ID NO: 10051099 - DNA, 22 bp, Homo sapiens
gtgctggcacccctctccagtt

SEQ ID NO: 10051100 - DNA, 22 bp, Homo sapiens
gggttggggcccagcagtctgc

SEQ ID NO: 10051101 - DNA, 22 bp, Homo sapiens
gggtgtcctgtgccaagctggg

SEQ ID NO: 10051102 - DNA, 22 bp, Homo sapiens
gggtgtccttctgtggactctg

SEQ ID NO: 10051103 - DNA, 22 bp, Homo sapiens
ggtcccagttgcccaggtcagg

SEQ ID NO: 10051104 - DNA, 22 bp, Homo sapiens
ggtcccaggttgacagggagac

SEQ ID NO: 10051105 - DNA, 22 bp, Homo sapiens
ggtccccgtggaggctggagcg

SEQ ID NO: 10051106 - DNA, 22 bp, Homo sapiens
ggtccccgtggaggctggagcg

SEQ ID NO: 10051107 - DNA, 22 bp, Homo sapiens
ggtccccgtggaggctggagcg

SEQ ID NO: 10051108 - DNA, 22 bp, Homo sapiens
ggtgagcactgccctgggtctc

SEQ ID NO: 10051109 - DNA, 22 bp, Homo sapiens
ggtgagcagctgtctgtatgga

SEQ ID NO: 10051110 - DNA, 22 bp, Homo sapiens
ggtgagggagtggaacgaggtg

SEQ ID NO: 10051111 - DNA, 23 bp, Homo sapiens
ggtggtgctcatatctcaggcct

SEQ ID NO: 10051112 - DNA, 22 bp, Homo sapiens
ggtgtttgcatggggccagttt

SEQ ID NO: 10051113 - DNA, 21 bp, Homo sapiens
ggttggtgtgtccagtggcca

SEQ ID NO: 10051114 - DNA, 22 bp, Homo sapiens
ggtttaaaagccatgcatgggg

SEQ ID NO: 10051115 - DNA, 22 bp, Homo sapiens
ggttcagtttacattaaaatct

SEQ ID NO: 10051116 - DNA, 22 bp, Homo sapiens
ggttggtgagtgcagggtgtta

SEQ ID NO: 10051117 - DNA, 22 bp, Homo sapiens
ggttggtgcccaggccatactg

SEQ ID NO: 10051118 - DNA, 21 bp, Homo sapiens
ggttggtgtgtccagtggcca

SEQ ID NO: 10051119 - DNA, 22 bp, Homo sapiens
ggttggggcgagctggaggccc

SEQ ID NO: 10051120 - DNA, 22 bp, Homo sapiens
ggtggatggactctcgggggcc

SEQ ID NO: 10051121 - DNA, 22 bp, Homo sapiens
ggtggagcgcagggtgctggcg

SEQ ID NO: 10051122 - DNA, 22 bp, Homo sapiens
ggtggagctatacgggatggct

SEQ ID NO: 10051123 - DNA, 19 bp, Homo sapiens
ggtggcagaacgtgggtcc

SEQ ID NO: 10051124 - DNA, 22 bp, Homo sapiens
ggtggggattcctgatcactgt

SEQ ID NO: 10051125 - DNA, 22 bp, Homo sapiens
ggtggggccagggctccaacct

SEQ ID NO: 10051126 - DNA, 22 bp, Homo sapiens
ggtggggcccaggcatctgatg

SEQ ID NO: 10051127 - DNA, 22 bp, Homo sapiens
ggtggggcccaggcatctgatg

SEQ ID NO: 10051128 - DNA, 22 bp, Homo sapiens
ggtggggccctggcactggtat

SEQ ID NO: 10051129 - DNA, 22 bp, Homo sapiens
ggtggggctaggacctcaggat

SEQ ID NO: 10051130 - DNA, 22 bp, Homo sapiens
ggtggggcctgctccagcggcc

SEQ ID NO: 10051131 - DNA, 22 bp, Homo sapiens
ggtggggccctggcactggtat

SEQ ID NO: 10051132 - DNA, 22 bp, Homo sapiens
ggtgggtgagccctgggagctg

SEQ ID NO: 10051133 - DNA, 22 bp, Homo sapiens
ggtgggtgcagggggcttctta

SEQ ID NO: 10051134 - DNA, 21 bp, Homo sapiens
gggtggggttccagccttttc

SEQ ID NO: 10051135 - DNA, 22 bp, Homo sapiens
gggtggtgtattagagctgcag

SEQ ID NO: 10051136 - DNA, 22 bp, Homo sapiens
gggtggtggccagcagtgggca

SEQ ID NO: 10051137 - DNA, 22 bp, Homo sapiens
ggggtggatttcaggcggtgtc

SEQ ID NO: 10051138 - DNA, 19 bp, Homo sapiens
ggggtggctggggctccag

SEQ ID NO: 10051139 - DNA, 22 bp, Homo sapiens
ggggcccagggcagcagtgcag

SEQ ID NO: 10051140 - DNA, 22 bp, Homo sapiens
ggggaggaagctggaacacggg

SEQ ID NO: 10051141 - DNA, 22 bp, Homo sapiens
ggggaggctgatgtgggcaaag

SEQ ID NO: 10051142 - DNA, 22 bp, Homo sapiens
ggggaggctgatgtgggcaaag

SEQ ID NO: 10051143 - DNA, 22 bp, Homo sapiens
ggggagtgttttcatgggcttg

SEQ ID NO: 10051144 - DNA, 22 bp, Homo sapiens
ggggccactggcaggaccttgg

SEQ ID NO: 10051145 - DNA, 22 bp, Homo sapiens
gggctgtttgcatatgtttata

SEQ ID NO: 10051146 - DNA, 22 bp, Homo sapiens
gccagctggtaggcacctagcc

SEQ ID NO: 10051147 - DNA, 22 bp, Homo sapiens
gccagaaagaggaggacctggg

SEQ ID NO: 10051148 - DNA, 22 bp, Homo sapiens
gcatttacatggagctatctaa

SEQ ID NO: 10051149 - DNA, 22 bp, Homo sapiens
gccacctccttattccacctgt

SEQ ID NO: 10051150 - DNA, 22 bp, Homo sapiens
gccacctcggctttctctgctc

SEQ ID NO: 10051151 - DNA, 23 bp, Homo sapiens
gccacctcctggtcagaaagagg

SEQ ID NO: 10051152 - DNA, 22 bp, Homo sapiens
gccacctcccaggacgaggctg

SEQ ID NO: 10051153 - DNA, 22 bp, Homo sapiens
gccacctctctcttgactcgag

SEQ ID NO: 10051154 - DNA, 20 bp, Homo sapiens
gccacctctctagcagtaga

SEQ ID NO: 10051155 - DNA, 21 bp, Homo sapiens
gccacctcgtctcggagcagc

SEQ ID NO: 10051156 - DNA, 22 bp, Homo sapiens
gccacctggactcagagccagg

SEQ ID NO: 10051157 - DNA, 22 bp, Homo sapiens
gcattacagcagttcaacttgg

SEQ ID NO: 10051158 - DNA, 22 bp, Homo sapiens
gcattcttcacagtattcctcc

SEQ ID NO: 10051159 - DNA, 22 bp, Homo sapiens
gcagtttagtagatgacattat

SEQ ID NO: 10051160 - DNA, 19 bp, Homo sapiens
gcctcatttccacctcccc

SEQ ID NO: 10051161 - DNA, 22 bp, Homo sapiens
gcccgtgtgcagagtgggagct

SEQ ID NO: 10051162 - DNA, 22 bp, Homo sapiens
gccccttctctgaggaacctgc

SEQ ID NO: 10051163 - DNA, 16 bp, Homo sapiens
gcctggagtggcaggg

SEQ ID NO: 10051164 - DNA, 22 bp, Homo sapiens
gcctggagtggacttggcccct

SEQ ID NO: 10051165 - DNA, 22 bp, Homo sapiens
gcctggagcccagtgtggggct

SEQ ID NO: 10051166 - DNA, 22 bp, Homo sapiens
gcctggagtagcatggcaagcc

SEQ ID NO: 10051167 - DNA, 22 bp, Homo sapiens
gcctggagaggaagccggtgga

SEQ ID NO: 10051168 - DNA, 22 bp, Homo sapiens
gcctggagagcactgtgcgctt

SEQ ID NO: 10051169 - DNA, 22 bp, Homo sapiens
gcctggagaagatggaactagc

SEQ ID NO: 10051170 - DNA, 18 bp, Homo sapiens
gcctccctggctacactt

SEQ ID NO: 10051171 - DNA, 19 bp, Homo sapiens
gcctgcagaaaaggcaggg

SEQ ID NO: 10051172 - DNA, 20 bp, Homo sapiens
gcctgcagagaaggtcagag

SEQ ID NO: 10051173 - DNA, 22 bp, Homo sapiens
gcagagtgaagcatttctttct

SEQ ID NO: 10051174 - DNA, 22 bp, Homo sapiens
gcagagtgagccgaggctgctc

SEQ ID NO: 10051175 - DNA, 22 bp, Homo sapiens
gcacccagatattgccttgacc

SEQ ID NO: 10051176 - DNA, 22 bp, Homo sapiens
gcaccaggagaatcacgttaga

SEQ ID NO: 10051177 - DNA, 22 bp, Homo sapiens
gcaccaggaagctgttatagca

SEQ ID NO: 10051178 - DNA, 22 bp, Homo sapiens
gcaccagctgccttctgtgccc

SEQ ID NO: 10051179 - DNA, 22 bp, Homo sapiens
gcaccagctgcagggtggctga

SEQ ID NO: 10051180 - DNA, 22 bp, Homo sapiens
gcaccagagggggctctgcagg

SEQ ID NO: 10051181 - DNA, 22 bp, Homo sapiens
gcaccagcctgagcctcttgca

SEQ ID NO: 10051182 - DNA, 18 bp, Homo sapiens
gcagacactcgtggaggg

SEQ ID NO: 10051183 - DNA, 22 bp, Homo sapiens
gcagacaggcccagtggaggga

SEQ ID NO: 10051184 - DNA, 22 bp, Homo sapiens
gcacagagagcagtgggggaca

SEQ ID NO: 10051185 - DNA, 19 bp, Homo sapiens
gcagggtggcagagctctt

SEQ ID NO: 10051186 - DNA, 22 bp, Homo sapiens
gcagggccttagcagcggctgc

SEQ ID NO: 10051187 - DNA, 22 bp, Homo sapiens
gcagggtgtgtctcatacagtt

SEQ ID NO: 10051188 - DNA, 19 bp, Homo sapiens
gcagggtgttgactgtccc

SEQ ID NO: 10051189 - DNA, 22 bp, Homo sapiens
gcaggtctatcaggctgcaggt

SEQ ID NO: 10051190 - DNA, 22 bp, Homo sapiens
gcaggtctcaatctgagcaggc

SEQ ID NO: 10051191 - DNA, 22 bp, Homo sapiens
gcaggtctggcatagagcctgc

SEQ ID NO: 10051192 - DNA, 22 bp, Homo sapiens
gcaggtctgttgattacagtca

SEQ ID NO: 10051193 - DNA, 22 bp, Homo sapiens
gcaggtcttgaaggtgtgattt

SEQ ID NO: 10051194 - DNA, 22 bp, Homo sapiens
gcagctgtcactttcacaatgc

SEQ ID NO: 10051195 - DNA, 22 bp, Homo sapiens
gcagccagccctagtcccactt

SEQ ID NO: 10051196 - DNA, 22 bp, Homo sapiens
gcagccagcccctctgacctct

SEQ ID NO: 10051197 - DNA, 22 bp, Homo sapiens
gcagccagcccctctgacctct

SEQ ID NO: 10051198 - DNA, 22 bp, Homo sapiens
gcagccagaagactcagaacaa

SEQ ID NO: 10051199 - DNA, 22 bp, Homo sapiens
gcagcagcccagggctctcaga

SEQ ID NO: 10051200 - DNA, 22 bp, Homo sapiens
gcagcagcaagaaggttggact

SEQ ID NO: 10051201 - DNA, 22 bp, Homo sapiens
gcagcagcaggcgctcggccgt

SEQ ID NO: 10051202 - DNA, 19 bp, Homo sapiens
gcagcaatagaagacaaat

SEQ ID NO: 10051203 - DNA, 22 bp, Homo sapiens
gcagcaataatgttttggagga

SEQ ID NO: 10051204 - DNA, 22 bp, Homo sapiens
gcagcaatcccaagtctgagtg

SEQ ID NO: 10051205 - DNA, 22 bp, Homo sapiens
gcagcaatcttcacagtgtcat

SEQ ID NO: 10051206 - DNA, 22 bp, Homo sapiens
gcagcaccaaccagggcctgtt

SEQ ID NO: 10051207 - DNA, 17 bp, Homo sapiens
gcagccagtgcagcagg

SEQ ID NO: 10051208 - DNA, 22 bp, Homo sapiens
gcagccaggtttgaggaccact

SEQ ID NO: 10051209 - DNA, 22 bp, Homo sapiens
gcagccaggaaagctggaccct

SEQ ID NO: 10051210 - DNA, 17 bp, Homo sapiens
gcagccagtgcagcagg

SEQ ID NO: 10051211 - DNA, 23 bp, Homo sapiens
gcagctggttagaagggaaggag

SEQ ID NO: 10051212 - DNA, 22 bp, Homo sapiens
gcagctgggacactgaggccag

SEQ ID NO: 10051213 - DNA, 22 bp, Homo sapiens
ggagctgtgcagtgactacaga

SEQ ID NO: 10051214 - DNA, 22 bp, Homo sapiens
ggagctgtctgtagggcacagg

SEQ ID NO: 10051215 - DNA, 22 bp, Homo sapiens
ggagctgtgctgggtgatcagg

SEQ ID NO: 10051216 - DNA, 22 bp, Homo sapiens
ggagctgttgattgtttgagga

SEQ ID NO: 10051217 - DNA, 20 bp, Homo sapiens
ggagctgccctgggctggag

SEQ ID NO: 10051218 - DNA, 22 bp, Homo sapiens
ggagctgggaactatgtagtat

SEQ ID NO: 10051219 - DNA, 22 bp, Homo sapiens
ggagcctggcaatgctgcgtcc

SEQ ID NO: 10051220 - DNA, 17 bp, Homo sapiens
ggagccaggagcccacc

SEQ ID NO: 10051221 - DNA, 22 bp, Homo sapiens
ggagccagtatttagtggtctt

SEQ ID NO: 10051222 - DNA, 22 bp, Homo sapiens
ggagaagaggagctggaagcct

SEQ ID NO: 10051223 - DNA, 22 bp, Homo sapiens
ggaaggctgtgcagtgtttgca

SEQ ID NO: 10051224 - DNA, 22 bp, Homo sapiens
ggacaggcccggggagcctgga

SEQ ID NO: 10051225 - DNA, 22 bp, Homo sapiens
ggacaggccctctggtcagctt

SEQ ID NO: 10051226 - DNA, 22 bp, Homo sapiens
ggacaggctgcatctgagcatg

SEQ ID NO: 10051227 - DNA, 22 bp, Homo sapiens
ggacagggatcattatctgagc

SEQ ID NO: 10051228 - DNA, 22 bp, Homo sapiens
ggagaaaggcatagcagaacct

SEQ ID NO: 10051229 - DNA, 22 bp, Homo sapiens
ggagaaagaaatttttgattgg

SEQ ID NO: 10051230 - DNA, 22 bp, Homo sapiens
ggactttaggaagggccaagtg

SEQ ID NO: 10051231 - DNA, 22 bp, Homo sapiens
ggactgtctactaacaagaagc

SEQ ID NO: 10051232 - DNA, 22 bp, Homo sapiens
gctgtctcatacaaggccctgc

SEQ ID NO: 10051233 - DNA, 22 bp, Homo sapiens
gctgtcccgaacccctggtaat

SEQ ID NO: 10051234 - DNA, 22 bp, Homo sapiens
gctgtcccatggttgcaagatg

SEQ ID NO: 10051235 - DNA, 22 bp, Homo sapiens
gctgtccaggttgtggagcaac

SEQ ID NO: 10051236 - DNA, 22 bp, Homo sapiens
gctgtgtgactgagagcctggc

SEQ ID NO: 10051237 - DNA, 22 bp, Homo sapiens
gctgtgtgctcacgtagtggaa

SEQ ID NO: 10051238 - DNA, 22 bp, Homo sapiens
gctgtacatcacaatttgctgt

SEQ ID NO: 10051239 - DNA, 22 bp, Homo sapiens
gctgtacattctgtgggtttgg

SEQ ID NO: 10051240 - DNA, 22 bp, Homo sapiens
gctgtcacatttggagcactgg

SEQ ID NO: 10051241 - DNA, 22 bp, Homo sapiens
gctgtgtgttcaataatgtgat

SEQ ID NO: 10051242 - DNA, 20 bp, Homo sapiens
gcttggaccttctgctctgt

SEQ ID NO: 10051243 - DNA, 22 bp, Homo sapiens
gctttaatgaagtcacgcaaag

SEQ ID NO: 10051244 - DNA, 22 bp, Homo sapiens
gctttaaatggcttgcccaagt

SEQ ID NO: 10051245 - DNA, 22 bp, Homo sapiens
gctttaaacctctactctgtcc

SEQ ID NO: 10051246 - DNA, 22 bp, Homo sapiens
gctttacatgatttctcaccct

SEQ ID NO: 10051247 - DNA, 22 bp, Homo sapiens
gcttttgtcattcaaatgctct

SEQ ID NO: 10051248 - DNA, 22 bp, Homo sapiens
gctttggtacctcctgctgatc

SEQ ID NO: 10051249 - DNA, 22 bp, Homo sapiens
gctttggtcaggtgtccagccc

SEQ ID NO: 10051250 - DNA, 22 bp, Homo sapiens
gctttggtcttctagctgtgag

SEQ ID NO: 10051251 - DNA, 22 bp, Homo sapiens
gctttggtgatacttgctggct

SEQ ID NO: 10051252 - DNA, 22 bp, Homo sapiens
gctttggttcaaccaggcaatt

SEQ ID NO: 10051253 - DNA, 23 bp, Homo sapiens
gctttatagttctcccaacatta

SEQ ID NO: 10051254 - DNA, 23 bp, Homo sapiens
gctttatagttctcccaacatta

SEQ ID NO: 10051255 - DNA, 22 bp, Homo sapiens
gctttatagccctattacatga

SEQ ID NO: 10051256 - DNA, 22 bp, Homo sapiens
gctttatagccctattacatga

SEQ ID NO: 10051257 - DNA, 22 bp, Homo sapiens
gctctccaggtctcatgcactg

SEQ ID NO: 10051258 - DNA, 22 bp, Homo sapiens
gctctctcttggggattcagca

SEQ ID NO: 10051259 - DNA, 20 bp, Homo sapiens
gctcccagcctgcagtcccc

SEQ ID NO: 10051260 - DNA, 22 bp, Homo sapiens
gctctgtcaacagctagctgtg

SEQ ID NO: 10051261 - DNA, 22 bp, Homo sapiens
gctctgggtagccactgcctgg

SEQ ID NO: 10051262 - DNA, 19 bp, Homo sapiens
gctaggtgaccagctggat

SEQ ID NO: 10051263 - DNA, 22 bp, Homo sapiens
gcctggagttcagccaagtccc

SEQ ID NO: 10051264 - DNA, 22 bp, Homo sapiens
gctgcctctgcacagctcactc

SEQ ID NO: 10051265 - DNA, 23 bp, Homo sapiens
gctgcctctgttggtcttcagtt

SEQ ID NO: 10051266 - DNA, 19 bp, Homo sapiens
gctgctggctctggctgga

SEQ ID NO: 10051267 - DNA, 22 bp, Homo sapiens
gctgctggcgctgggcgtccgg

SEQ ID NO: 10051268 - DNA, 22 bp, Homo sapiens
gctgctggaacaaatcacccca

SEQ ID NO: 10051269 - DNA, 22 bp, Homo sapiens
gctgctgcttgaaggctcggag

SEQ ID NO: 10051270 - DNA, 22 bp, Homo sapiens
gctgctgggaatgaacagtgtt

SEQ ID NO: 10051271 - DNA, 22 bp, Homo sapiens
gctgctgggaatgaacagtgtt

SEQ ID NO: 10051272 - DNA, 18 bp, Homo sapiens
gctgctggtggagggagc

SEQ ID NO: 10051273 - DNA, 22 bp, Homo sapiens
gaggtggcttagtctctggaca

SEQ ID NO: 10051274 - DNA, 22 bp, Homo sapiens
gaggtgggagggcagtccctaa

SEQ ID NO: 10051275 - DNA, 22 bp, Homo sapiens
gagggtgcaggaggatggtagt

SEQ ID NO: 10051276 - DNA, 22 bp, Homo sapiens
gaggcctgtcgctaggcctctg

SEQ ID NO: 10051277 - DNA, 22 bp, Homo sapiens
gagggacagctaaagagaaatt

SEQ ID NO: 10051278 - DNA, 22 bp, Homo sapiens
gagcaggcaactctgcagtgcc

SEQ ID NO: 10051279 - DNA, 22 bp, Homo sapiens
gagcaggcattctagtggctga

SEQ ID NO: 10051280 - DNA, 19 bp, Homo sapiens
gagcaggccacacatgtgt

SEQ ID NO: 10051281 - DNA, 19 bp, Homo sapiens
gagcaggccacacatgtgt

SEQ ID NO: 10051282 - DNA, 22 bp, Homo sapiens
gagcaggcctggggtgaggcct

SEQ ID NO: 10051283 - DNA, 22 bp, Homo sapiens
gagcaggcctggggtgaggcct

SEQ ID NO: 10051284 - DNA, 22 bp, Homo sapiens
gagctcattcattcattgcctg

SEQ ID NO: 10051285 - DNA, 22 bp, Homo sapiens
gagctccagcatctctgccaaa

SEQ ID NO: 10051286 - DNA, 22 bp, Homo sapiens
gagctcagcccaaagagcagtg

SEQ ID NO: 10051287 - DNA, 20 bp, Homo sapiens
gaggatgcagacagagggca

SEQ ID NO: 10051288 - DNA, 22 bp, Homo sapiens
gaggagagaagctaacggtgct

SEQ ID NO: 10051289 - DNA, 22 bp, Homo sapiens
gaggagacatatttttgaagca

SEQ ID NO: 10051290 - DNA, 22 bp, Homo sapiens
gacatggatacttgataagggg

SEQ ID NO: 10051291 - DNA, 22 bp, Homo sapiens
gacatgctaattactggttcaa

SEQ ID NO: 10051292 - DNA, 22 bp, Homo sapiens
gacatgggatgagatgaagcat

SEQ ID NO: 10051293 - DNA, 22 bp, Homo sapiens
gacatcaggaagacatgagagg

SEQ ID NO: 10051294 - DNA, 22 bp, Homo sapiens
gacagtcccccagcagcaaacc

SEQ ID NO: 10051295 - DNA, 22 bp, Homo sapiens
gacagtccttgcccagtatcta

SEQ ID NO: 10051296 - DNA, 22 bp, Homo sapiens
gacagcatggtgtctgttcagg

SEQ ID NO: 10051297 - DNA, 22 bp, Homo sapiens
gacagcagggacatgtaggaag

SEQ ID NO: 10051298 - DNA, 22 bp, Homo sapiens
gacagcaggtgcttgggaaagg

SEQ ID NO: 10051299 - DNA, 22 bp, Homo sapiens
gacagcagtcctggagttccca

SEQ ID NO: 10051300 - DNA, 22 bp, Homo sapiens
gacaaaactgagatcacactgt

SEQ ID NO: 10051301 - DNA, 22 bp, Homo sapiens
gacaaaagtgttttgaacaagg

SEQ ID NO: 10051302 - DNA, 22 bp, Homo sapiens
gacaaaactgagatcacactgt

SEQ ID NO: 10051303 - DNA, 22 bp, Homo sapiens
gacaaaacacattagtttaaaa

SEQ ID NO: 10051304 - DNA, 22 bp, Homo sapiens
gacagcagggaaagtccagacc

SEQ ID NO: 10051305 - DNA, 22 bp, Homo sapiens
gacagcaggatgtgaggggatg

SEQ ID NO: 10051306 - DNA, 22 bp, Homo sapiens
gacagcagccacagggagaggg

SEQ ID NO: 10051307 - DNA, 22 bp, Homo sapiens
gacaaatgagtctcatacccgg

SEQ ID NO: 10051308 - DNA, 22 bp, Homo sapiens
gacaaatgaagtcactgacctt

SEQ ID NO: 10051309 - DNA, 22 bp, Homo sapiens
gacaaatgaatgatgaacacca

SEQ ID NO: 10051310 - DNA, 22 bp, Homo sapiens
gacaaatgaatgatgaacacca

SEQ ID NO: 10051311 - DNA, 22 bp, Homo sapiens
gacaacaataatgtggagctga

SEQ ID NO: 10051312 - DNA, 22 bp, Homo sapiens
gaatgctattatttctgtgtgt

SEQ ID NO: 10051313 - DNA, 22 bp, Homo sapiens
gaatgcattctcttagcatcta

SEQ ID NO: 10051314 - DNA, 22 bp, Homo sapiens
gaattacatagtttctaggttc

SEQ ID NO: 10051315 - DNA, 22 bp, Homo sapiens
gaattacataataaaatgagag

SEQ ID NO: 10051316 - DNA, 22 bp, Homo sapiens
gaattacataataaaatgagag

SEQ ID NO: 10051317 - DNA, 22 bp, Homo sapiens
gaattacagagttgttaagtca

SEQ ID NO: 10051318 - DNA, 22 bp, Homo sapiens
gaattacagccagaagaatgaa

SEQ ID NO: 10051319 - DNA, 22 bp, Homo sapiens
gaattacaaagtgagacaagct

SEQ ID NO: 10051320 - DNA, 22 bp, Homo sapiens
gagcacagtaaagcagtgtcac

SEQ ID NO: 10051321 - DNA, 22 bp, Homo sapiens
gagcagagcttctcaaagtaaa

SEQ ID NO: 10051322 - DNA, 22 bp, Homo sapiens
gagcagagaatccagctaagtg

SEQ ID NO: 10051323 - DNA, 22 bp, Homo sapiens
gagaggcaggaatcctgggtga

SEQ ID NO: 10051324 - DNA, 22 bp, Homo sapiens
gagagctgtcagcgtagcaccg

SEQ ID NO: 10051325 - DNA, 22 bp, Homo sapiens
gagagcaggaggcagcgggacg

SEQ ID NO: 10051326 - DNA, 22 bp, Homo sapiens
gagagccatggtggagatgggg

SEQ ID NO: 10051327 - DNA, 22 bp, Homo sapiens
gagagacagcacacagtgtggg

SEQ ID NO: 10051328 - DNA, 22 bp, Homo sapiens
gagagacagcagaacgtgcagc

SEQ ID NO: 10051329 - DNA, 22 bp, Homo sapiens
gagaactcagacgcaggtcatg

SEQ ID NO: 10051330 - DNA, 19 bp, Homo sapiens
gactccaactttaagcatg

SEQ ID NO: 10051331 - DNA, 19 bp, Homo sapiens
gactcacaccttccgctgt

SEQ ID NO: 10051332 - DNA, 22 bp, Homo sapiens
cttggaaactttccctgggcac

SEQ ID NO: 10051333 - DNA, 22 bp, Homo sapiens
ctttctcttcactgtcatgatc

SEQ ID NO: 10051334 - DNA, 21 bp, Homo sapiens
ctttgcatacagatgccaatt

SEQ ID NO: 10051335 - DNA, 21 bp, Homo sapiens
ctttgcatctatatgttctca

SEQ ID NO: 10051336 - DNA, 22 bp, Homo sapiens
ctttgcattctcagcacagagc

SEQ ID NO: 10051337 - DNA, 20 bp, Homo sapiens
ctttctctaatttataagta

SEQ ID NO: 10051338 - DNA, 20 bp, Homo sapiens
ctttctctaatttataagta

SEQ ID NO: 10051339 - DNA, 22 bp, Homo sapiens
cttcccagaacaatgtaggctt

SEQ ID NO: 10051340 - DNA, 22 bp, Homo sapiens
cttcccagcacctcagtctggc

SEQ ID NO: 10051341 - DNA, 22 bp, Homo sapiens
cttcccagcacctcagtctggc

SEQ ID NO: 10051342 - DNA, 22 bp, Homo sapiens
cttcactgtttggttcacagca

SEQ ID NO: 10051343 - DNA, 22 bp, Homo sapiens
cttcacagtcaccctgctgtgt

SEQ ID NO: 10051344 - DNA, 22 bp, Homo sapiens
cttcacagtaaatccagaagaa

SEQ ID NO: 10051345 - DNA, 22 bp, Homo sapiens
gaaattattgctagagactgca

SEQ ID NO: 10051346 - DNA, 20 bp, Homo sapiens
gaaattctcgtattagttta

SEQ ID NO: 10051347 - DNA, 22 bp, Homo sapiens
gaaattctgtgtcccagagtgc

SEQ ID NO: 10051348 - DNA, 22 bp, Homo sapiens
gaagaacgtcttataaattcac

SEQ ID NO: 10051349 - DNA, 22 bp, Homo sapiens
gaactttaaaacaaagtacagt

SEQ ID NO: 10051350 - DNA, 22 bp, Homo sapiens
gaaatgtgcagaatgtgttaga

SEQ ID NO: 10051351 - DNA, 22 bp, Homo sapiens
gaaagacatagttgcaagatgg

SEQ ID NO: 10051352 - DNA, 22 bp, Homo sapiens
gaaatatacattgcaggaagag

SEQ ID NO: 10051353 - DNA, 22 bp, Homo sapiens
gaaaccagctagaggcagaggg

SEQ ID NO: 10051354 - DNA, 22 bp, Homo sapiens
cttttttcctaaggcaacatga

SEQ ID NO: 10051355 - DNA, 22 bp, Homo sapiens
cttttttcctaaggcaacatga

SEQ ID NO: 10051356 - DNA, 22 bp, Homo sapiens
gaaactctcgcatcctgggaac

SEQ ID NO: 10051357 - DNA, 22 bp, Homo sapiens
ctttggaatgcacagaggtgta

SEQ ID NO: 10051358 - DNA, 22 bp, Homo sapiens
ctttggaacatactgctgagct

SEQ ID NO: 10051359 - DNA, 22 bp, Homo sapiens
ctttggaataatcaagctctga

SEQ ID NO: 10051360 - DNA, 22 bp, Homo sapiens
ctttggaagtgatagatatgat

SEQ ID NO: 10051361 - DNA, 22 bp, Homo sapiens
ctttttctaatcataattgtct

SEQ ID NO: 10051362 - DNA, 16 bp, Homo sapiens
ctttttctcccctctt

SEQ ID NO: 10051363 - DNA, 22 bp, Homo sapiens
ctttttctaatcataattgtct

SEQ ID NO: 10051364 - DNA, 22 bp, Homo sapiens
cttttgttaggagaaaacatca

SEQ ID NO: 10051365 - DNA, 22 bp, Homo sapiens
ctgggtggaaagtgctgagaat

SEQ ID NO: 10051366 - DNA, 22 bp, Homo sapiens
ctgggtggctgtccagccagcc

SEQ ID NO: 10051367 - DNA, 22 bp, Homo sapiens
ctggtgtctgattctcccctga

SEQ ID NO: 10051368 - DNA, 22 bp, Homo sapiens
ctggtgtctgctccctcacagc

SEQ ID NO: 10051369 - DNA, 22 bp, Homo sapiens
ctggtgtcattttagcctcagg

SEQ ID NO: 10051370 - DNA, 22 bp, Homo sapiens
ctggtgttgtccgggtgagagt

SEQ ID NO: 10051371 - DNA, 22 bp, Homo sapiens
ctggtgtggactccgcgcggag

SEQ ID NO: 10051372 - DNA, 22 bp, Homo sapiens
ctggttattattcttggaatgc

SEQ ID NO: 10051373 - DNA, 22 bp, Homo sapiens
ctggtgtttattacaggtgctc

SEQ ID NO: 10051374 - DNA, 22 bp, Homo sapiens
ctggtgccctgtgtggcaggag

SEQ ID NO: 10051375 - DNA, 22 bp, Homo sapiens
ctggggtgtctcgtctgccatt

SEQ ID NO: 10051376 - DNA, 22 bp, Homo sapiens
ctggggtgtctcgtctgccatt

SEQ ID NO: 10051377 - DNA, 22 bp, Homo sapiens
ctggggtggaggagctcccctg

SEQ ID NO: 10051378 - DNA, 22 bp, Homo sapiens
ctggggtggatgggtccaagtt

SEQ ID NO: 10051379 - DNA, 22 bp, Homo sapiens
ctggggtggagattggcaatct

SEQ ID NO: 10051380 - DNA, 22 bp, Homo sapiens
ctggggtgaaggattacctgag

SEQ ID NO: 10051381 - DNA, 22 bp, Homo sapiens
ctgggggtcgcgcctctgggca

SEQ ID NO: 10051382 - DNA, 22 bp, Homo sapiens
ctgggaggcggaggttgcagtg

SEQ ID NO: 10051383 - DNA, 22 bp, Homo sapiens
ctggagctaggaagtccaagat

SEQ ID NO: 10051384 - DNA, 22 bp, Homo sapiens
ctggagctcagcccaggttcca

SEQ ID NO: 10051385 - DNA, 22 bp, Homo sapiens
ctgggctcagtgtctcactcct

SEQ ID NO: 10051386 - DNA, 22 bp, Homo sapiens
ctgggcctcatgcacagagatg

SEQ ID NO: 10051387 - DNA, 22 bp, Homo sapiens
ctggtttgcccacaccagccac

SEQ ID NO: 10051388 - DNA, 22 bp, Homo sapiens
ctggttggaggagaagtttgga

SEQ ID NO: 10051389 - DNA, 22 bp, Homo sapiens
ctggttggaagtgcagactctc

SEQ ID NO: 10051390 - DNA, 22 bp, Homo sapiens
ctggttgggaggttggctttca

SEQ ID NO: 10051391 - DNA, 22 bp, Homo sapiens
ctggttggtgccacatggtggc

SEQ ID NO: 10051392 - DNA, 22 bp, Homo sapiens
ctgtccattttcgtgcctcctt

SEQ ID NO: 10051393 - DNA, 22 bp, Homo sapiens
ctgtgaaatgctttgcgatggt

SEQ ID NO: 10051394 - DNA, 22 bp, Homo sapiens
ctgtgacagggatcagaatgca

SEQ ID NO: 10051395 - DNA, 22 bp, Homo sapiens
ctgtgacagagcttgagtgaga

SEQ ID NO: 10051396 - DNA, 22 bp, Homo sapiens
ctgtgacagtttctcagacttt

SEQ ID NO: 10051397 - DNA, 22 bp, Homo sapiens
ctgtgacagtttctcagaattt

SEQ ID NO: 10051398 - DNA, 22 bp, Homo sapiens
ctgtgaccttagcaagggaaat

SEQ ID NO: 10051399 - DNA, 22 bp, Homo sapiens
ctgtgagaaataaatgtttgct

SEQ ID NO: 10051400 - DNA, 22 bp, Homo sapiens
ctgtgagatatgcatatgctct

SEQ ID NO: 10051401 - DNA, 22 bp, Homo sapiens
ctgtggcattgtgaggactgca

SEQ ID NO: 10051402 - DNA, 22 bp, Homo sapiens
ctgtggagtttgtggcgctgac

SEQ ID NO: 10051403 - DNA, 22 bp, Homo sapiens
ctgtgggagggaaggcgcggcc

SEQ ID NO: 10051404 - DNA, 22 bp, Homo sapiens
ctgtgggatgggacctcagctg

SEQ ID NO: 10051405 - DNA, 22 bp, Homo sapiens
ctgtggtgagcaactgactgaa

SEQ ID NO: 10051406 - DNA, 23 bp, Homo sapiens
ctgtggtgaggccctagaatctg

SEQ ID NO: 10051407 - DNA, 22 bp, Homo sapiens
ctgtgtttctcttgacccaagt

SEQ ID NO: 10051408 - DNA, 22 bp, Homo sapiens
ctgtgtttctgagaagtgggga

SEQ ID NO: 10051409 - DNA, 22 bp, Homo sapiens
ctgtgttcccctgctgctgagg

SEQ ID NO: 10051410 - DNA, 22 bp, Homo sapiens
ctgtgtgtttatatcatttcct

SEQ ID NO: 10051411 - DNA, 22 bp, Homo sapiens
ctgtgttttgattaaaaagcaa

SEQ ID NO: 10051412 - DNA, 22 bp, Homo sapiens
ctgtgtttgctatgcaaagaca

SEQ ID NO: 10051413 - DNA, 22 bp, Homo sapiens
ctgtgtttgatgagaagccacc

SEQ ID NO: 10051414 - DNA, 22 bp, Homo sapiens
ctgtgtgtgtctgcagcatact

SEQ ID NO: 10051415 - DNA, 22 bp, Homo sapiens
ctgtgtgtgctacaggcttcca

SEQ ID NO: 10051416 - DNA, 22 bp, Homo sapiens
ctgtgtgtgagaagcaggttga

SEQ ID NO: 10051417 - DNA, 23 bp, Homo sapiens
ctgtgtgtgccgagggtggccac

SEQ ID NO: 10051418 - DNA, 22 bp, Homo sapiens
ctgtgtgtgagaagcaggttga

SEQ ID NO: 10051419 - DNA, 22 bp, Homo sapiens
ctcagagagtgaattcctgcct

SEQ ID NO: 10051420 - DNA, 19 bp, Homo sapiens
ctcagagaggggcagtgcc

SEQ ID NO: 10051421 - DNA, 21 bp, Homo sapiens
ctcagagacaaatgccatccc

SEQ ID NO: 10051422 - DNA, 21 bp, Homo sapiens
ctcagagaaatgtctgggagc

SEQ ID NO: 10051423 - DNA, 22 bp, Homo sapiens
ctcagagaaatgtcacaacaat

SEQ ID NO: 10051424 - DNA, 22 bp, Homo sapiens
ctcagagaacctaagcggagga

SEQ ID NO: 10051425 - DNA, 22 bp, Homo sapiens
ctcagagaagtctttgctaaac

SEQ ID NO: 10051426 - DNA, 22 bp, Homo sapiens
ttctttctgtccataatgagac

SEQ ID NO: 10051427 - DNA, 22 bp, Homo sapiens
ctcagaaagggttgctgagggc

SEQ ID NO: 10051428 - DNA, 18 bp, Homo sapiens
ctcaccattctgcccaat

SEQ ID NO: 10051429 - DNA, 22 bp, Homo sapiens
ctcacccagaggctttccccct

SEQ ID NO: 10051430 - DNA, 22 bp, Homo sapiens
ctcacaggttctgcagctcaca

SEQ ID NO: 10051431 - DNA, 22 bp, Homo sapiens
ctatactactatacagatgtaa

SEQ ID NO: 10051432 - DNA, 22 bp, Homo sapiens
ctcacctgcaatcccttccagg

SEQ ID NO: 10051433 - DNA, 22 bp, Homo sapiens
ctcacctataagtctcacagtc

SEQ ID NO: 10051434 - DNA, 22 bp, Homo sapiens
ctcacccatatctccatgactc

SEQ ID NO: 10051435 - DNA, 22 bp, Homo sapiens
ttctggcttagttgttgtatat

SEQ ID NO: 10051436 - DNA, 22 bp, Homo sapiens
ttctgcatctatttttctgctg

SEQ ID NO: 10051437 - DNA, 22 bp, Homo sapiens
cgttagtggagtttgaagctgt

SEQ ID NO: 10051438 - DNA, 22 bp, Homo sapiens
cgtgtgtgtacctgcgcattta

SEQ ID NO: 10051439 - DNA, 22 bp, Homo sapiens
ctagagctgttctgtgcactca

SEQ ID NO: 10051440 - DNA, 22 bp, Homo sapiens
ctagagaagaggctcagccagc

SEQ ID NO: 10051441 - DNA, 22 bp, Homo sapiens
ttgcatcaattccttgtcctga

SEQ ID NO: 10051442 - DNA, 22 bp, Homo sapiens
ttgcatcagaattacttggagg

SEQ ID NO: 10051443 - DNA, 22 bp, Homo sapiens
ctcaggtcgctatttctcttac

SEQ ID NO: 10051444 - DNA, 22 bp, Homo sapiens
ctcaggaggtggtagaggccct

SEQ ID NO: 10051445 - DNA, 22 bp, Homo sapiens
ttggatccatctcaggcatagg

SEQ ID NO: 10051446 - DNA, 22 bp, Homo sapiens
ttggaagatctaacagaggcat

SEQ ID NO: 10051447 - DNA, 22 bp, Homo sapiens
ttggaagcattctgaatgtcca

SEQ ID NO: 10051448 - DNA, 22 bp, Homo sapiens
ttggaaaagcgttctctgtagc

SEQ ID NO: 10051449 - DNA, 22 bp, Homo sapiens
ctccagaggatgcaggtgaggg

SEQ ID NO: 10051450 - DNA, 22 bp, Homo sapiens
ctccagaggaaagcacatagtg

SEQ ID NO: 10051451 - DNA, 22 bp, Homo sapiens
ctccagagtcatcgagcattcc

SEQ ID NO: 10051452 - DNA, 22 bp, Homo sapiens
ttatatttctggtagccttcag

SEQ ID NO: 10051453 - DNA, 22 bp, Homo sapiens
ttatattgtgtaataagtgaag

SEQ ID NO: 10051454 - DNA, 22 bp, Homo sapiens
ttatattagttagacttgctgt

SEQ ID NO: 10051455 - DNA, 22 bp, Homo sapiens
ttatcattgtcgcagtctaatt

SEQ ID NO: 10051456 - DNA, 22 bp, Homo sapiens
ttatcagagtccccaaaagaaa

SEQ ID NO: 10051457 - DNA, 22 bp, Homo sapiens
ttataacatcaatcagagttaa

SEQ ID NO: 10051458 - DNA, 22 bp, Homo sapiens
ttataactttggatatgacaag

SEQ ID NO: 10051459 - DNA, 22 bp, Homo sapiens
ttataacactgccttgtcacca

SEQ ID NO: 10051460 - DNA, 22 bp, Homo sapiens
ttataacaacagtttactttaa

SEQ ID NO: 10051461 - DNA, 22 bp, Homo sapiens
ttataacaacagtttactttaa

SEQ ID NO: 10051462 - DNA, 22 bp, Homo sapiens
ccttcaatcagcagtctagctt

SEQ ID NO: 10051463 - DNA, 22 bp, Homo sapiens
ccttcaatcttaagtcagccca

SEQ ID NO: 10051464 - DNA, 22 bp, Homo sapiens
ccttcagccagttttctttgtt

SEQ ID NO: 10051465 - DNA, 22 bp, Homo sapiens
ccttcagcctagaacttgagag

SEQ ID NO: 10051466 - DNA, 22 bp, Homo sapiens
ccttcagcctcaagatccttca

SEQ ID NO: 10051467 - DNA, 22 bp, Homo sapiens
ccttcagcctcaagatccttca

SEQ ID NO: 10051468 - DNA, 22 bp, Homo sapiens
ccttcagccttcatccttcctt

SEQ ID NO: 10051469 - DNA, 22 bp, Homo sapiens
ccttcagccttcatccttcctt

SEQ ID NO: 10051470 - DNA, 22 bp, Homo sapiens
ttacataacggtatgaaaaatg

SEQ ID NO: 10051471 - DNA, 18 bp, Homo sapiens
ccttcagctctgccagta

SEQ ID NO: 10051472 - DNA, 22 bp, Homo sapiens
ccttcagcgtcccctttacccg

SEQ ID NO: 10051473 - DNA, 22 bp, Homo sapiens
ccttcagcctttgtttatcaga

SEQ ID NO: 10051474 - DNA, 22 bp, Homo sapiens
tgtcagagcaatgaggttcagc

SEQ ID NO: 10051475 - DNA, 22 bp, Homo sapiens
ttaaattatttctagtgaggtg

SEQ ID NO: 10051476 - DNA, 22 bp, Homo sapiens
ccttagaaggctgaataattct

SEQ ID NO: 10051477 - DNA, 22 bp, Homo sapiens
ttacaaagcaggtcagctgaaa

SEQ ID NO: 10051478 - DNA, 22 bp, Homo sapiens
ttacaaagattatattcagtta

SEQ ID NO: 10051479 - DNA, 22 bp, Homo sapiens
ttacagttaatgtgactaacca

SEQ ID NO: 10051480 - DNA, 22 bp, Homo sapiens
ttacagttactggtactgttaa

SEQ ID NO: 10051481 - DNA, 22 bp, Homo sapiens
ttacagtttaagaggaaacaaa

SEQ ID NO: 10051482 - DNA, 22 bp, Homo sapiens
ttacagtttacataagaattgt

SEQ ID NO: 10051483 - DNA, 22 bp, Homo sapiens
ttacagtttaccaagaatattg

SEQ ID NO: 10051484 - DNA, 22 bp, Homo sapiens
ttacagtttatccaggaagagc

SEQ ID NO: 10051485 - DNA, 22 bp, Homo sapiens
cgagagttagctaggagtcaca

SEQ ID NO: 10051486 - DNA, 22 bp, Homo sapiens
ccttttctaggatgctttatag

SEQ ID NO: 10051487 - DNA, 22 bp, Homo sapiens
ccttttctatccttctaggttc

SEQ ID NO: 10051488 - DNA, 22 bp, Homo sapiens
cctttggtaattctgtgtagag

SEQ ID NO: 10051489 - DNA, 22 bp, Homo sapiens
cctttggtaacattccaacctt

SEQ ID NO: 10051490 - DNA, 22 bp, Homo sapiens
ccttttcttgccactgactcgg

SEQ ID NO: 10051491 - DNA, 22 bp, Homo sapiens
cgctggcttcctcctggggcca

SEQ ID NO: 10051492 - DNA, 22 bp, Homo sapiens
ttcaaattaccacatttgctta

SEQ ID NO: 10051493 - DNA, 22 bp, Homo sapiens
cggagtcttgctatgttgccca

SEQ ID NO: 10051494 - DNA, 22 bp, Homo sapiens
cggggccctggggctgaaggtc

SEQ ID NO: 10051495 - DNA, 22 bp, Homo sapiens
cggggctgaggcaacgcggaga

SEQ ID NO: 10051496 - DNA, 22 bp, Homo sapiens
cggggctgcgctcttcctgccg

SEQ ID NO: 10051497 - DNA, 22 bp, Homo sapiens
cgtggggcgggtggacacttgc

SEQ ID NO: 10051498 - DNA, 22 bp, Homo sapiens
cggggctgctcgtcctcctgtg

SEQ ID NO: 10051499 - DNA, 22 bp, Homo sapiens
cggggccctggggctgaaggtc

SEQ ID NO: 10051500 - DNA, 22 bp, Homo sapiens
cggggccctggggctgaaggtc

SEQ ID NO: 10051501 - DNA, 22 bp, Homo sapiens
cgggctggctgcagctgctgga

SEQ ID NO: 10051502 - DNA, 22 bp, Homo sapiens
tttgcaaagtgcttgcagagta

SEQ ID NO: 10051503 - DNA, 22 bp, Homo sapiens
ctctggagtgcagcctggtggc

SEQ ID NO: 10051504 - DNA, 22 bp, Homo sapiens
tttgagaagcatctggtccact

SEQ ID NO: 10051505 - DNA, 22 bp, Homo sapiens
tttgagaaatgggctctgtgct

SEQ ID NO: 10051506 - DNA, 22 bp, Homo sapiens
tttgagaaatgggctctgtgct

SEQ ID NO: 10051507 - DNA, 22 bp, Homo sapiens
tttgaaagaaaccagtgagtga

SEQ ID NO: 10051508 - DNA, 22 bp, Homo sapiens
tttgaaaatttaagtgctacac

SEQ ID NO: 10051509 - DNA, 22 bp, Homo sapiens
tttgaaaattagacacaggcta

SEQ ID NO: 10051510 - DNA, 22 bp, Homo sapiens
ttttctcttccctctggacctg

SEQ ID NO: 10051511 - DNA, 22 bp, Homo sapiens
ctctgtgttccgggttgctgct

SEQ ID NO: 10051512 - DNA, 22 bp, Homo sapiens
ctctgtgtggtcctctgtattg

SEQ ID NO: 10051513 - DNA, 22 bp, Homo sapiens
ctctgtgtggtcctctgtattg

SEQ ID NO: 10051514 - DNA, 22 bp, Homo sapiens
ctctgtgtcagctgggtgtgca

SEQ ID NO: 10051515 - DNA, 22 bp, Homo sapiens
ctctgtgtatccaagttcaggt

SEQ ID NO: 10051516 - DNA, 22 bp, Homo sapiens
ctctgtggttagactatggctg

SEQ ID NO: 10051517 - DNA, 22 bp, Homo sapiens
tttggaatgttaggtgtctcat

SEQ ID NO: 10051518 - DNA, 22 bp, Homo sapiens
tttatattacctggaatagctt

SEQ ID NO: 10051519 - DNA, 22 bp, Homo sapiens
tttatgattattttaaagcagc

SEQ ID NO: 10051520 - DNA, 22 bp, Homo sapiens
tttcagaaccaagagagacatc

SEQ ID NO: 10051521 - DNA, 22 bp, Homo sapiens
tttcagaaccgctaaaataaat

SEQ ID NO: 10051522 - DNA, 22 bp, Homo sapiens
tttcagaagtcaactaggtaaa

SEQ ID NO: 10051523 - DNA, 22 bp, Homo sapiens
tttcagaaggggagaaaggtca

SEQ ID NO: 10051524 - DNA, 22 bp, Homo sapiens
tttcagaaccgctaaaataaat

SEQ ID NO: 10051525 - DNA, 22 bp, Homo sapiens
tttcagaaggggagaaaggtca

SEQ ID NO: 10051526 - DNA, 22 bp, Homo sapiens
tttcagaaccaagagagacatc

SEQ ID NO: 10051527 - DNA, 22 bp, Homo sapiens
ctccttcacgcaggctgccatg

SEQ ID NO: 10051528 - DNA, 22 bp, Homo sapiens
ctccttcatgtcatgtgtccgg

SEQ ID NO: 10051529 - DNA, 22 bp, Homo sapiens
ctccttcatgtcatgtgtccgg

SEQ ID NO: 10051530 - DNA, 22 bp, Homo sapiens
tttcagaatagcaaagcaagct

SEQ ID NO: 10051531 - DNA, 23 bp, Homo sapiens
tttcagaagtggtcctaggaagc

SEQ ID NO: 10051532 - DNA, 22 bp, Homo sapiens
tttcagaagtcacagttgactg

SEQ ID NO: 10051533 - DNA, 22 bp, Homo sapiens
tttcagaagtcacagttgactg

SEQ ID NO: 10051534 - DNA, 22 bp, Homo sapiens
tttcagaatagcaaagcaagct

SEQ ID NO: 10051535 - DNA, 22 bp, Homo sapiens
ctccttcctgcagatctgagat

SEQ ID NO: 10051536 - DNA, 22 bp, Homo sapiens
tttcagtttccagctttgtcat

SEQ ID NO: 10051537 - DNA, 22 bp, Homo sapiens
tttcagtttatgtcttgaatta

SEQ ID NO: 10051538 - DNA, 22 bp, Homo sapiens
tttcagtttagactaaaggtag

SEQ ID NO: 10051539 - DNA, 22 bp, Homo sapiens
tttccaagtgtcaggtgcaaaa

SEQ ID NO: 10051540 - DNA, 22 bp, Homo sapiens
tttccaagataatacacagaaa

SEQ ID NO: 10051541 - DNA, 18 bp, Homo sapiens
tttccaagaagagagctc

SEQ ID NO: 10051542 - DNA, 22 bp, Homo sapiens
tttccaatgtagatgtctctgg

SEQ ID NO: 10051543 - DNA, 22 bp, Homo sapiens
tttctcaaaagacagaagtgaa

SEQ ID NO: 10051544 - DNA, 23 bp, Homo sapiens
tttctcaaagagtggcagcttca

SEQ ID NO: 10051545 - DNA, 22 bp, Homo sapiens
tttctcaagtactgcacatgaa

SEQ ID NO: 10051546 - DNA, 22 bp, Homo sapiens
ctctctttcattggtcgccttg

SEQ ID NO: 10051547 - DNA, 18 bp, Homo sapiens
ctctctttccactctttg

SEQ ID NO: 10051548 - DNA, 22 bp, Homo sapiens
ctctctttctgaatgaggacta

SEQ ID NO: 10051549 - DNA, 22 bp, Homo sapiens
ctctctttgatgtataaataat

SEQ ID NO: 10051550 - DNA, 22 bp, Homo sapiens
ctctctttttcgtgtgccgaag

SEQ ID NO: 10051551 - DNA, 20 bp, Homo sapiens
ctgcccagccactgagggat

SEQ ID NO: 10051552 - DNA, 22 bp, Homo sapiens
ctcttctctgcagcctttgaag

SEQ ID NO: 10051553 - DNA, 22 bp, Homo sapiens
ttttggaatcatttacagagca

SEQ ID NO: 10051554 - DNA, 22 bp, Homo sapiens
ctgagcagaagggtgcacgtgc

SEQ ID NO: 10051555 - DNA, 22 bp, Homo sapiens
ctgagcagaccatggcagaggt

SEQ ID NO: 10051556 - DNA, 19 bp, Homo sapiens
ctgagcagcggcagcactt

SEQ ID NO: 10051557 - DNA, 22 bp, Homo sapiens
ctgagcagctgttacagagtgt

SEQ ID NO: 10051558 - DNA, 22 bp, Homo sapiens
ctgagcagtgctttgcagtggg

SEQ ID NO: 10051559 - DNA, 22 bp, Homo sapiens
ctgagcagtctgactcaagcta

SEQ ID NO: 10051560 - DNA, 22 bp, Homo sapiens
ctgagcatggccggtccatggt

SEQ ID NO: 10051561 - DNA, 22 bp, Homo sapiens
ctggagcaggtttaggagtccc

SEQ ID NO: 10051562 - DNA, 22 bp, Homo sapiens
ctggagccggcgagccccagcc

SEQ ID NO: 10051563 - DNA, 22 bp, Homo sapiens
ctggagaacagagctgtttaga

SEQ ID NO: 10051564 - DNA, 20 bp, Homo sapiens
ctggaagcctttccagagca

SEQ ID NO: 10051565 - DNA, 22 bp, Homo sapiens
ctggaagaggaagccagctgga

SEQ ID NO: 10051566 - DNA, 22 bp, Homo sapiens
ctgctgtgagtggttcttgcct

SEQ ID NO: 10051567 - DNA, 22 bp, Homo sapiens
ctgctgtctagtatcttaaaaa

SEQ ID NO: 10051568 - DNA, 22 bp, Homo sapiens
ctgctgtctcactggtgtggtt

SEQ ID NO: 10051569 - DNA, 22 bp, Homo sapiens
ctgctgggaaggtctgctcagt

SEQ ID NO: 10051570 - DNA, 22 bp, Homo sapiens
ctgctcttgagggactgcggtc

SEQ ID NO: 10051571 - DNA, 22 bp, Homo sapiens
ctgctcttcccactcactccca

SEQ ID NO: 10051572 - DNA, 22 bp, Homo sapiens
ctgctgacagccctgcttcagg

SEQ ID NO: 10051573 - DNA, 22 bp, Homo sapiens
ctgctgggtccccctgctgatt

SEQ ID NO: 10051574 - DNA, 22 bp, Homo sapiens
ctgctggggtcagagcactggg

SEQ ID NO: 10051575 - DNA, 22 bp, Homo sapiens
ctgctgggtctatgcaagtgga

SEQ ID NO: 10051576 - DNA, 19 bp, Homo sapiens
ctgctgggtgctgagggag

SEQ ID NO: 10051577 - DNA, 22 bp, Homo sapiens
ctgcctgtttcctcttgctccc

SEQ ID NO: 10051578 - DNA, 22 bp, Homo sapiens
ctgcctgtttcctcttgctccc

SEQ ID NO: 10051579 - DNA, 22 bp, Homo sapiens
ctgcctgtggtctgtgatctaa

SEQ ID NO: 10051580 - DNA, 22 bp, Homo sapiens
ctgctcttcacactacacccgt

SEQ ID NO: 10051581 - DNA, 22 bp, Homo sapiens
tgacagagacttcagagccaaa

SEQ ID NO: 10051582 - DNA, 22 bp, Homo sapiens
tgacaattcattatatctacag

SEQ ID NO: 10051583 - DNA, 22 bp, Homo sapiens
ccagggcatgtaactaatggtg

SEQ ID NO: 10051584 - DNA, 22 bp, Homo sapiens
ccagggccaagagacctcgagg

SEQ ID NO: 10051585 - DNA, 22 bp, Homo sapiens
tgactttgtccctttcaaatcc

SEQ ID NO: 10051586 - DNA, 22 bp, Homo sapiens
tgactttggataagaaaatgag

SEQ ID NO: 10051587 - DNA, 22 bp, Homo sapiens
tgactttaataggattttgcat

SEQ ID NO: 10051588 - DNA, 21 bp, Homo sapiens
tgactttatttgacagcccag

SEQ ID NO: 10051589 - DNA, 23 bp, Homo sapiens
tgagctgggcctgcaggggtctc

SEQ ID NO: 10051590 - DNA, 22 bp, Homo sapiens
ccagtgtgccaatttacagctg

SEQ ID NO: 10051591 - DNA, 22 bp, Homo sapiens
tgagcagactctgcagagccac

SEQ ID NO: 10051592 - DNA, 22 bp, Homo sapiens
tgagcagacttgatgaggcagc

SEQ ID NO: 10051593 - DNA, 22 bp, Homo sapiens
tgagcagaagccctcctggact

SEQ ID NO: 10051594 - DNA, 22 bp, Homo sapiens
tgagcagaaaagaatgctgagc

SEQ ID NO: 10051595 - DNA, 22 bp, Homo sapiens
tgagcagaaaagaatgctgagc

SEQ ID NO: 10051596 - DNA, 22 bp, Homo sapiens
tgagcacctactgtattccagg

SEQ ID NO: 10051597 - DNA, 19 bp, Homo sapiens
tgagactgggtgcagtact

SEQ ID NO: 10051598 - DNA, 22 bp, Homo sapiens
tgagacttcctgatgaggcccg

SEQ ID NO: 10051599 - DNA, 22 bp, Homo sapiens
tgagaggtgaggcatgaggcat

SEQ ID NO: 10051600 - DNA, 22 bp, Homo sapiens
ccagggtggcgtagatgctggg

SEQ ID NO: 10051601 - DNA, 22 bp, Homo sapiens
tgaaagcattagtctaaggtag

SEQ ID NO: 10051602 - DNA, 22 bp, Homo sapiens
tgaaagctgtccactaggctgt

SEQ ID NO: 10051603 - DNA, 22 bp, Homo sapiens
tctttattttatgcttgtgcaa

SEQ ID NO: 10051604 - DNA, 22 bp, Homo sapiens
tctttattttatgcttgtgcaa

SEQ ID NO: 10051605 - DNA, 22 bp, Homo sapiens
tctttatttctgaatcccccat

SEQ ID NO: 10051606 - DNA, 22 bp, Homo sapiens
tctttatttctgaatcccccat

SEQ ID NO: 10051607 - DNA, 22 bp, Homo sapiens
tctttatttaagtctgttgtaa

SEQ ID NO: 10051608 - DNA, 22 bp, Homo sapiens
tctttaatataaaggaatgaat

SEQ ID NO: 10051609 - DNA, 22 bp, Homo sapiens
tctttaatataaaggaatgaat

SEQ ID NO: 10051610 - DNA, 22 bp, Homo sapiens
ccaggctcaggcctgctcgttg

SEQ ID NO: 10051611 - DNA, 22 bp, Homo sapiens
ccaggctcagcgcgcacgtctg

SEQ ID NO: 10051612 - DNA, 22 bp, Homo sapiens
ccaggctcacagcatcccagga

SEQ ID NO: 10051613 - DNA, 22 bp, Homo sapiens
tctgcagacaggaagctgaggc

SEQ ID NO: 10051614 - DNA, 23 bp, Homo sapiens
tctgcagacgctgttctattgtc

SEQ ID NO: 10051615 - DNA, 22 bp, Homo sapiens
tctgcagaggtaatttacagat

SEQ ID NO: 10051616 - DNA, 22 bp, Homo sapiens
tctgcagacttgcctaagtgtg

SEQ ID NO: 10051617 - DNA, 22 bp, Homo sapiens
tctgcagagacaaagtgttatt

SEQ ID NO: 10051618 - DNA, 22 bp, Homo sapiens
tctgcagagcattatagcaaaa

SEQ ID NO: 10051619 - DNA, 22 bp, Homo sapiens
ccagccggactccacttcccgt

SEQ ID NO: 10051620 - DNA, 22 bp, Homo sapiens
tcttgtgtggaactgcttttct

SEQ ID NO: 10051621 - DNA, 22 bp, Homo sapiens
tctttaaagttggagcttgcaa

SEQ ID NO: 10051622 - DNA, 22 bp, Homo sapiens
tcttgtttcttctaagcagcag

SEQ ID NO: 10051623 - DNA, 22 bp, Homo sapiens
tcttgtttggattttgggcagt

SEQ ID NO: 10051624 - DNA, 22 bp, Homo sapiens
tcttgtatgtgtattttgctgt

SEQ ID NO: 10051625 - DNA, 21 bp, Homo sapiens
tcttgtattggatctgtgtgt

SEQ ID NO: 10051626 - DNA, 22 bp, Homo sapiens
ccagcctcactggcatcaccta

SEQ ID NO: 10051627 - DNA, 21 bp, Homo sapiens
ccagcctcagatcagggagct

SEQ ID NO: 10051628 - DNA, 22 bp, Homo sapiens
tgattatattctaacttcataa

SEQ ID NO: 10051629 - DNA, 22 bp, Homo sapiens
cccaaaggttgaggctgcagtg

SEQ ID NO: 10051630 - DNA, 22 bp, Homo sapiens
cccaacaacatgaaactaccta

SEQ ID NO: 10051631 - DNA, 22 bp, Homo sapiens
cccaaagtacaagtaaacatgt

SEQ ID NO: 10051632 - DNA, 22 bp, Homo sapiens
tgatacagtcagctcacaattg

SEQ ID NO: 10051633 - DNA, 23 bp, Homo sapiens
ccagtgtggctctgtccgctctc

SEQ ID NO: 10051634 - DNA, 22 bp, Homo sapiens
cccagagaagtgaagtgacttg

SEQ ID NO: 10051635 - DNA, 22 bp, Homo sapiens
tgcagagtaaaagcagatgcta

SEQ ID NO: 10051636 - DNA, 22 bp, Homo sapiens
cccagagatctactgagcccag

SEQ ID NO: 10051637 - DNA, 22 bp, Homo sapiens
cccagagagcatttggacaaag

SEQ ID NO: 10051638 - DNA, 22 bp, Homo sapiens
cccagagagcacaggtggtggg

SEQ ID NO: 10051639 - DNA, 22 bp, Homo sapiens
cccagagaggtaaaacagcctt

SEQ ID NO: 10051640 - DNA, 22 bp, Homo sapiens
cccagagactttgtccgacgac

SEQ ID NO: 10051641 - DNA, 22 bp, Homo sapiens
cccagagaattccacatagagg

SEQ ID NO: 10051642 - DNA, 22 bp, Homo sapiens
tgcagcaggtatggcaagctcc

SEQ ID NO: 10051643 - DNA, 22 bp, Homo sapiens
cccagcagccagaatgaggagc

SEQ ID NO: 10051644 - DNA, 23 bp, Homo sapiens
cccagcagagatgaggaggggtc

SEQ ID NO: 10051645 - DNA, 22 bp, Homo sapiens
cccacccactctgaccagaagc

SEQ ID NO: 10051646 - DNA, 22 bp, Homo sapiens
cccaagggtgcccagcagagga

SEQ ID NO: 10051647 - DNA, 22 bp, Homo sapiens
cccagcaggtgccatcactctg

SEQ ID NO: 10051648 - DNA, 22 bp, Homo sapiens
cccagcatttctgggctgcact

SEQ ID NO: 10051649 - DNA, 20 bp, Homo sapiens
cccagcccctacctgttgcc

SEQ ID NO: 10051650 - DNA, 22 bp, Homo sapiens
cccagcccccgagtgtctggaa

SEQ ID NO: 10051651 - DNA, 22 bp, Homo sapiens
cccagccctgacctattggaaa

SEQ ID NO: 10051652 - DNA, 20 bp, Homo sapiens
cccagcccgggccgcgctcg

SEQ ID NO: 10051653 - DNA, 22 bp, Homo sapiens
cccagcccacggtcctgggtgg

SEQ ID NO: 10051654 - DNA, 18 bp, Homo sapiens
cccagcccaccatttctc

SEQ ID NO: 10051655 - DNA, 22 bp, Homo sapiens
cccagcccatctcaaaggtcta

SEQ ID NO: 10051656 - DNA, 22 bp, Homo sapiens
cccagcccagcgttcgaggggt

SEQ ID NO: 10051657 - DNA, 22 bp, Homo sapiens
tgcagtctgtacattttaagaa

SEQ ID NO: 10051658 - DNA, 22 bp, Homo sapiens
tgcagtggaagaggtggagatc

SEQ ID NO: 10051659 - DNA, 22 bp, Homo sapiens
tgcagtggaatctggagagcag

SEQ ID NO: 10051660 - DNA, 22 bp, Homo sapiens
tgcatcaaaactggactccttc

SEQ ID NO: 10051661 - DNA, 22 bp, Homo sapiens
tgcatattgtccttgatattat

SEQ ID NO: 10051662 - DNA, 22 bp, Homo sapiens
cccaggagacagaaacagaggt

SEQ ID NO: 10051663 - DNA, 19 bp, Homo sapiens
cctcaccctgcagaggagg

SEQ ID NO: 10051664 - DNA, 22 bp, Homo sapiens
cctcagccttggccccaggcag

SEQ ID NO: 10051665 - DNA, 22 bp, Homo sapiens
ccggagagtcagagcgcggccc

SEQ ID NO: 10051666 - DNA, 22 bp, Homo sapiens
ccggctcggcgaccaggctgaa

SEQ ID NO: 10051667 - DNA, 22 bp, Homo sapiens
cctcacagaggggcagccatct

SEQ ID NO: 10051668 - DNA, 22 bp, Homo sapiens
tggaggtgagtgtggtacagca

SEQ ID NO: 10051669 - DNA, 22 bp, Homo sapiens
tggaggtgagtgtggtacagca

SEQ ID NO: 10051670 - DNA, 22 bp, Homo sapiens
tggacaggttgagtaggaggag

SEQ ID NO: 10051671 - DNA, 22 bp, Homo sapiens
tggacaggtttgggtgcctgtt

SEQ ID NO: 10051672 - DNA, 23 bp, Homo sapiens
tggacagtagggtagacagtgcc

SEQ ID NO: 10051673 - DNA, 22 bp, Homo sapiens
tggacagttgtcttgtagctaa

SEQ ID NO: 10051674 - DNA, 22 bp, Homo sapiens
tgctttatttataaaatagcaa

SEQ ID NO: 10051675 - DNA, 22 bp, Homo sapiens
tgcctgcctcaggccgagtgct

SEQ ID NO: 10051676 - DNA, 22 bp, Homo sapiens
tgcctgcctctggcagccctgc

SEQ ID NO: 10051677 - DNA, 22 bp, Homo sapiens
tgcctcagtttctccatatgaa

SEQ ID NO: 10051678 - DNA, 22 bp, Homo sapiens
tgcctcagtttcatctgcagaa

SEQ ID NO: 10051679 - DNA, 22 bp, Homo sapiens
tggaaggcctgttgtgtcctag

SEQ ID NO: 10051680 - DNA, 23 bp, Homo sapiens
tgtcaacaaaactttcaggagaa

SEQ ID NO: 10051681 - DNA, 22 bp, Homo sapiens
tgtattcagtgcctagcatatg

SEQ ID NO: 10051682 - DNA, 22 bp, Homo sapiens
tgtattcagtgatttcacaata

SEQ ID NO: 10051683 - DNA, 22 bp, Homo sapiens
tgtcaacagatactagagagct

SEQ ID NO: 10051684 - DNA, 22 bp, Homo sapiens
tgtcaacattggctgacagttg

SEQ ID NO: 10051685 - DNA, 22 bp, Homo sapiens
cctggaggcggaggttgcagtg

SEQ ID NO: 10051686 - DNA, 22 bp, Homo sapiens
cctggaggctctgggagggcag

SEQ ID NO: 10051687 - DNA, 22 bp, Homo sapiens
tgtacatgaataaaagatcttg

SEQ ID NO: 10051688 - DNA, 22 bp, Homo sapiens
tgtacagtgtaaataagtggat

SEQ ID NO: 10051689 - DNA, 22 bp, Homo sapiens
tgtacagtggaaaatggattcg

SEQ ID NO: 10051690 - DNA, 22 bp, Homo sapiens
tgtaattaacgttcttgttaga

SEQ ID NO: 10051691 - DNA, 22 bp, Homo sapiens
tgtaattatgttgttagagtat

SEQ ID NO: 10051692 - DNA, 22 bp, Homo sapiens
tgtaatgggctactaggaagag

SEQ ID NO: 10051693 - DNA, 22 bp, Homo sapiens
tgtaaagagaagaaacgtgagc

SEQ ID NO: 10051694 - DNA, 22 bp, Homo sapiens
tgtaaagacagataaaacagca

SEQ ID NO: 10051695 - DNA, 22 bp, Homo sapiens
tgtaataatgaggcatccagcc

SEQ ID NO: 10051696 - DNA, 22 bp, Homo sapiens
tgtaagttttgtgaaacaaaca

SEQ ID NO: 10051697 - DNA, 22 bp, Homo sapiens
tgtaatggagcttagagttatc

SEQ ID NO: 10051698 - DNA, 22 bp, Homo sapiens
tgtaatggaaaaacattagcat

SEQ ID NO: 10051699 - DNA, 22 bp, Homo sapiens
cctgctggacctcaacacattt

SEQ ID NO: 10051700 - DNA, 22 bp, Homo sapiens
cctgctggacaggggtgttcat

SEQ ID NO: 10051701 - DNA, 22 bp, Homo sapiens
cctgctgcttaggccatatttc

SEQ ID NO: 10051702 - DNA, 22 bp, Homo sapiens
tggtctgctgaacagccgtatc

SEQ ID NO: 10051703 - DNA, 20 bp, Homo sapiens
tggtctggagccagtgagga

SEQ ID NO: 10051704 - DNA, 22 bp, Homo sapiens
tggtctgattcttgctccccaa

SEQ ID NO: 10051705 - DNA, 22 bp, Homo sapiens
tggtctgataccggattccagt

SEQ ID NO: 10051706 - DNA, 23 bp, Homo sapiens
tggtctgaagcctcaggttcctc

SEQ ID NO: 10051707 - DNA, 22 bp, Homo sapiens
cctgccttcccagcttggcttt

SEQ ID NO: 10051708 - DNA, 22 bp, Homo sapiens
cctgctgtgaccggggagcagg

SEQ ID NO: 10051709 - DNA, 20 bp, Homo sapiens
cctgctgtgctttccatgga

SEQ ID NO: 10051710 - DNA, 20 bp, Homo sapiens
cctgctgggaaccctctgaa

SEQ ID NO: 10051711 - DNA, 22 bp, Homo sapiens
cctgctggctggtagagttccg

SEQ ID NO: 10051712 - DNA, 22 bp, Homo sapiens
cctgctggcggggacccagtga

SEQ ID NO: 10051713 - DNA, 22 bp, Homo sapiens
cctgctggccagtggagggctg

SEQ ID NO: 10051714 - DNA, 22 bp, Homo sapiens
cctgctggcattcttgctccct

SEQ ID NO: 10051715 - DNA, 18 bp, Homo sapiens
cctgccagtctggagcag

SEQ ID NO: 10051716 - DNA, 22 bp, Homo sapiens
cctgccagggccagaggccagc

SEQ ID NO: 10051717 - DNA, 22 bp, Homo sapiens
tgggagcctggcaggccagagg

SEQ ID NO: 10051718 - DNA, 22 bp, Homo sapiens
tgggccactcttccctgggtct

SEQ ID NO: 10051719 - DNA, 22 bp, Homo sapiens
cctgacaggagaagcgcagcat

SEQ ID NO: 10051720 - DNA, 22 bp, Homo sapiens
tggggtcccactcagctcccct

SEQ ID NO: 10051721 - DNA, 22 bp, Homo sapiens
tggggtcctctcacttggaggg

SEQ ID NO: 10051722 - DNA, 17 bp, Homo sapiens
tggggtccccgatggtg

SEQ ID NO: 10051723 - DNA, 22 bp, Homo sapiens
tctctgagttttaaggatgatg

SEQ ID NO: 10051724 - DNA, 22 bp, Homo sapiens
tctctgggaattcacaagccct

SEQ ID NO: 10051725 - DNA, 22 bp, Homo sapiens
ccagcagagtctaggaaggagg

SEQ ID NO: 10051726 - DNA, 22 bp, Homo sapiens
ccagcagcagcgtccaaggaga

SEQ ID NO: 10051727 - DNA, 22 bp, Homo sapiens
ccagcagagttggtttctggta

SEQ ID NO: 10051728 - DNA, 22 bp, Homo sapiens
ccagcagcaggccaggccctcc

SEQ ID NO: 10051729 - DNA, 22 bp, Homo sapiens
ccagcagcccacaggcgtccct

SEQ ID NO: 10051730 - DNA, 22 bp, Homo sapiens
ccagcagccagagaaggacctc

SEQ ID NO: 10051731 - DNA, 22 bp, Homo sapiens
ccagcagctttattggctctcc

SEQ ID NO: 10051732 - DNA, 22 bp, Homo sapiens
ccagcagggaaaaacccaccaa

SEQ ID NO: 10051733 - DNA, 22 bp, Homo sapiens
tctgagagtacgggctgcgcgc

SEQ ID NO: 10051734 - DNA, 22 bp, Homo sapiens
tctgagagctgccatctcattt

SEQ ID NO: 10051735 - DNA, 22 bp, Homo sapiens
tctgagaggtgaattcagcaaa

SEQ ID NO: 10051736 - DNA, 22 bp, Homo sapiens
tctgagagcaaggcattagcag

SEQ ID NO: 10051737 - DNA, 22 bp, Homo sapiens
ccagcatttgcttaatttggag

SEQ ID NO: 10051738 - DNA, 22 bp, Homo sapiens
tctctgtgtgttggctgtatat

SEQ ID NO: 10051739 - DNA, 22 bp, Homo sapiens
tctctgtgtgccttcatctgcc

SEQ ID NO: 10051740 - DNA, 18 bp, Homo sapiens
ccagcatgccagaggctg

SEQ ID NO: 10051741 - DNA, 22 bp, Homo sapiens
ccagcatccatgctccctcggg

SEQ ID NO: 10051742 - DNA, 22 bp, Homo sapiens
tctgaatttcccaaggctatct

SEQ ID NO: 10051743 - DNA, 19 bp, Homo sapiens
tctgaattatttatgtacc

SEQ ID NO: 10051744 - DNA, 22 bp, Homo sapiens
ccacccttgggttcggaggccg

SEQ ID NO: 10051745 - DNA, 22 bp, Homo sapiens
tcgggctcgctctcctagcgga

SEQ ID NO: 10051746 - DNA, 22 bp, Homo sapiens
tcgggctcgctctcctagcgga

SEQ ID NO: 10051747 - DNA, 22 bp, Homo sapiens
tcggggtctttgacacgctctg

SEQ ID NO: 10051748 - DNA, 22 bp, Homo sapiens
tcggggatgggagagagctcca

SEQ ID NO: 10051749 - DNA, 22 bp, Homo sapiens
tcggggtctttgacacgctctg

SEQ ID NO: 10051750 - DNA, 22 bp, Homo sapiens
ccaccaagtcccactataattt

SEQ ID NO: 10051751 - DNA, 22 bp, Homo sapiens
ccaccacatttgcctagacttt

SEQ ID NO: 10051752 - DNA, 22 bp, Homo sapiens
tcgcgggttgcacatggccatc

SEQ ID NO: 10051753 - DNA, 22 bp, Homo sapiens
tcctctctgcactggccctgcc

SEQ ID NO: 10051754 - DNA, 22 bp, Homo sapiens
ccacatggagcaggaggtgggg

SEQ ID NO: 10051755 - DNA, 22 bp, Homo sapiens
ccactttgaaccactgaggtgg

SEQ ID NO: 10051756 - DNA, 18 bp, Homo sapiens
ccactttgcagcctggcc

SEQ ID NO: 10051757 - DNA, 22 bp, Homo sapiens
ccactttgagaagctgatgaaa

SEQ ID NO: 10051758 - DNA, 22 bp, Homo sapiens
ccacttgtgaaataatcaaata

SEQ ID NO: 10051759 - DNA, 22 bp, Homo sapiens
tctccacagtcccacctcgctt

SEQ ID NO: 10051760 - DNA, 22 bp, Homo sapiens
tctcaacaccacttgctgaaga

SEQ ID NO: 10051761 - DNA, 22 bp, Homo sapiens
tctcaactaatggtgcaagatg

SEQ ID NO: 10051762 - DNA, 22 bp, Homo sapiens
ccacctcctaggcctggagaag

SEQ ID NO: 10051763 - DNA, 22 bp, Homo sapiens
ccacctcctcggccatgtgacg

SEQ ID NO: 10051764 - DNA, 22 bp, Homo sapiens
tctcccacagtctcccatggct

SEQ ID NO: 10051765 - DNA, 22 bp, Homo sapiens
ccagagaggccaaggtcgtggt

SEQ ID NO: 10051766 - DNA, 22 bp, Homo sapiens
ccagagaggcaaaactccttcc

SEQ ID NO: 10051767 - DNA, 21 bp, Homo sapiens
tctccagagtgggaggaaatc

SEQ ID NO: 10051768 - DNA, 22 bp, Homo sapiens
ccagagagagaggtcaatggca

SEQ ID NO: 10051769 - DNA, 19 bp, Homo sapiens
ccagagagctaggtacaga

SEQ ID NO: 10051770 - DNA, 22 bp, Homo sapiens
ccagagagctacaaggcataaa

SEQ ID NO: 10051771 - DNA, 22 bp, Homo sapiens
ccagagagagtactgggctctg

SEQ ID NO: 10051772 - DNA, 21 bp, Homo sapiens
ccagagagagggaagtgggtt

SEQ ID NO: 10051773 - DNA, 22 bp, Homo sapiens
tccacatccattgcttgacttt

SEQ ID NO: 10051774 - DNA, 22 bp, Homo sapiens
tccacaggtccggcatgaacag

SEQ ID NO: 10051775 - DNA, 22 bp, Homo sapiens
tcatttatcgctgccttttaaa

SEQ ID NO: 10051776 - DNA, 21 bp, Homo sapiens
tcatttattgagaaatgactg

SEQ ID NO: 10051777 - DNA, 22 bp, Homo sapiens
tcattcggcaatagtgtgttag

SEQ ID NO: 10051778 - DNA, 19 bp, Homo sapiens
catctttggtcacctagtc

SEQ ID NO: 10051779 - DNA, 22 bp, Homo sapiens
catgaaaaatttactgttaaca

SEQ ID NO: 10051780 - DNA, 22 bp, Homo sapiens
catcttttggtaggagccgggc

SEQ ID NO: 10051781 - DNA, 22 bp, Homo sapiens
catcttttggcctattctgagg

SEQ ID NO: 10051782 - DNA, 22 bp, Homo sapiens
catcttttcagaagccattctg

SEQ ID NO: 10051783 - DNA, 22 bp, Homo sapiens
tcatcagtccttttcattatga

SEQ ID NO: 10051784 - DNA, 22 bp, Homo sapiens
cataacagtggcttcagcaagt

SEQ ID NO: 10051785 - DNA, 20 bp, Homo sapiens
tcatgcaagattcataaagg

SEQ ID NO: 10051786 - DNA, 22 bp, Homo sapiens
tccagcctcatttctcctgctt

SEQ ID NO: 10051787 - DNA, 22 bp, Homo sapiens
tccagctcttcagttctgcaaa

SEQ ID NO: 10051788 - DNA, 22 bp, Homo sapiens
tccagctcttgttgcccactgc

SEQ ID NO: 10051789 - DNA, 22 bp, Homo sapiens
tccagccctgtggcttccaccc

SEQ ID NO: 10051790 - DNA, 22 bp, Homo sapiens
tccagagagccacggacagggg

SEQ ID NO: 10051791 - DNA, 22 bp, Homo sapiens
tccagagagatagtggctaata

SEQ ID NO: 10051792 - DNA, 22 bp, Homo sapiens
tccagagagaaaaacaagcttt

SEQ ID NO: 10051793 - DNA, 22 bp, Homo sapiens
tccagagaattctacgcagtgc

SEQ ID NO: 10051794 - DNA, 22 bp, Homo sapiens
tccagagacttgcatgtgcttg

SEQ ID NO: 10051795 - DNA, 22 bp, Homo sapiens
tccagagaacgatgaaagctgg

SEQ ID NO: 10051796 - DNA, 22 bp, Homo sapiens
catgttaaaatatacattctga

SEQ ID NO: 10051797 - DNA, 22 bp, Homo sapiens
tcccactgagcatatgcagatg

SEQ ID NO: 10051798 - DNA, 22 bp, Homo sapiens
cattcattctgtaagtaactat

SEQ ID NO: 10051799 - DNA, 22 bp, Homo sapiens
tcccagagcctctgccactctg

SEQ ID NO: 10051800 - DNA, 22 bp, Homo sapiens
tcccagagctctgacaccagct

SEQ ID NO: 10051801 - DNA, 22 bp, Homo sapiens
tcccagaggaaatggcagctga

SEQ ID NO: 10051802 - DNA, 22 bp, Homo sapiens
tcccagccaggctctaccactt

SEQ ID NO: 10051803 - DNA, 22 bp, Homo sapiens
tcccaggacatgggctctgctc

SEQ ID NO: 10051804 - DNA, 22 bp, Homo sapiens
tcccaggaatccgtcctctaga

SEQ ID NO: 10051805 - DNA, 22 bp, Homo sapiens
catgttctcttaatgttaacta

SEQ ID NO: 10051806 - DNA, 22 bp, Homo sapiens
catgttctaatattgtgacata

SEQ ID NO: 10051807 - DNA, 22 bp, Homo sapiens
catgttaatgaatttttgcagt

SEQ ID NO: 10051808 - DNA, 22 bp, Homo sapiens
catgttaatatgcattgagtac

SEQ ID NO: 10051809 - DNA, 22 bp, Homo sapiens
catgttaaattgagtttgcaat

SEQ ID NO: 10051810 - DNA, 22 bp, Homo sapiens
catgttgtagtatcataatggt

SEQ ID NO: 10051811 - DNA, 22 bp, Homo sapiens
catgttgtgaaggaaaatgggc

SEQ ID NO: 10051812 - DNA, 22 bp, Homo sapiens
catgttgtattctttggctggt

SEQ ID NO: 10051813 - DNA, 22 bp, Homo sapiens
catttgtagttaaaaatgtctc

SEQ ID NO: 10051814 - DNA, 22 bp, Homo sapiens
tccctcactggttctgcatccc

SEQ ID NO: 10051815 - DNA, 22 bp, Homo sapiens
tccccagattcatgtctgctgt

SEQ ID NO: 10051816 - DNA, 22 bp, Homo sapiens
tcccggcgctgggaggtgggtc

SEQ ID NO: 10051817 - DNA, 22 bp, Homo sapiens
tccctagaggtcttcacaagat

SEQ ID NO: 10051818 - DNA, 22 bp, Homo sapiens
tagaggagaacacaaattatag

SEQ ID NO: 10051819 - DNA, 22 bp, Homo sapiens
tagagctggaaaactgcaggta

SEQ ID NO: 10051820 - DNA, 19 bp, Homo sapiens
tagagctgcttcctggcag

SEQ ID NO: 10051821 - DNA, 22 bp, Homo sapiens
tagagctggaatttgcagcaag

SEQ ID NO: 10051822 - DNA, 22 bp, Homo sapiens
tagagctgggcagtgctctgag

SEQ ID NO: 10051823 - DNA, 22 bp, Homo sapiens
tagagctggccgggacagctgg

SEQ ID NO: 10051824 - DNA, 17 bp, Homo sapiens
tagagctggttcaggag

SEQ ID NO: 10051825 - DNA, 22 bp, Homo sapiens
tagagctgctggactgtaacag

SEQ ID NO: 10051826 - DNA, 22 bp, Homo sapiens
caggctgggctggtgttagagt

SEQ ID NO: 10051827 - DNA, 22 bp, Homo sapiens
tagctacacatctaaacagcaa

SEQ ID NO: 10051828 - DNA, 22 bp, Homo sapiens
cagggcagaacatatagatagt

SEQ ID NO: 10051829 - DNA, 22 bp, Homo sapiens
tagataatttggcatcatattg

SEQ ID NO: 10051830 - DNA, 22 bp, Homo sapiens
tactatttggaattttaaattg

SEQ ID NO: 10051831 - DNA, 21 bp, Homo sapiens
tactgtagccttgcactgtag

SEQ ID NO: 10051832 - DNA, 17 bp, Homo sapiens
gtgagggcagaggatgg

SEQ ID NO: 10051833 - DNA, 22 bp, Homo sapiens
gtgagggcagaacccccaggcc

SEQ ID NO: 10051834 - DNA, 23 bp, Homo sapiens
tactgtgctgaatatttgagagg

SEQ ID NO: 10051835 - DNA, 22 bp, Homo sapiens
tactgtgaatacaaaataaatt

SEQ ID NO: 10051836 - DNA, 22 bp, Homo sapiens
tactgtgacagagtacttaaac

SEQ ID NO: 10051837 - DNA, 22 bp, Homo sapiens
caggctggagtgcagtggggcg

SEQ ID NO: 10051838 - DNA, 22 bp, Homo sapiens
tagaacataagtcattcatttg

SEQ ID NO: 10051839 - DNA, 22 bp, Homo sapiens
caggctggagtgcagtggcgct

SEQ ID NO: 10051840 - DNA, 22 bp, Homo sapiens
caggctggagtgcagtggcgct

SEQ ID NO: 10051841 - DNA, 22 bp, Homo sapiens
caggctggagtgcagtggcgcc

SEQ ID NO: 10051842 - DNA, 22 bp, Homo sapiens
caggctggagtgcagtggcgcc

SEQ ID NO: 10051843 - DNA, 22 bp, Homo sapiens
cagggtggcaggcaccatggcc

SEQ ID NO: 10051844 - DNA, 22 bp, Homo sapiens
tatcataagttaattaaacagt

SEQ ID NO: 10051845 - DNA, 23 bp, Homo sapiens
tatcagtaagcatccctgaaccc

SEQ ID NO: 10051846 - DNA, 19 bp, Homo sapiens
tagtgagtagtgaattaga

SEQ ID NO: 10051847 - DNA, 22 bp, Homo sapiens
tagtgaaagtcaaagacagcta

SEQ ID NO: 10051848 - DNA, 22 bp, Homo sapiens
tagtgaaacagttatcaatctg

SEQ ID NO: 10051849 - DNA, 22 bp, Homo sapiens
tagggtacatgtgcacaacatg

SEQ ID NO: 10051850 - DNA, 22 bp, Homo sapiens
tagggcctgacattcagtaggt

SEQ ID NO: 10051851 - DNA, 22 bp, Homo sapiens
tagggctattctgagtaataat

SEQ ID NO: 10051852 - DNA, 22 bp, Homo sapiens
tagggctataagagaataagac

SEQ ID NO: 10051853 - DNA, 22 bp, Homo sapiens
cagggccttatcctgccattga

SEQ ID NO: 10051854 - DNA, 22 bp, Homo sapiens
tagctcatgtaatccgaacata

SEQ ID NO: 10051855 - DNA, 22 bp, Homo sapiens
cagggcagccaggccccgtggg

SEQ ID NO: 10051856 - DNA, 22 bp, Homo sapiens
cagggcaggaatttgacattgc

SEQ ID NO: 10051857 - DNA, 21 bp, Homo sapiens
tcagagaacccggcaggcaag

SEQ ID NO: 10051858 - DNA, 22 bp, Homo sapiens
tcagagaacacagaggtgatgt

SEQ ID NO: 10051859 - DNA, 22 bp, Homo sapiens
tcagagaaatgaagtagggatt

SEQ ID NO: 10051860 - DNA, 22 bp, Homo sapiens
tcagagaaataattgctgagtt

SEQ ID NO: 10051861 - DNA, 22 bp, Homo sapiens
cagtggggggactgaggcctga

SEQ ID NO: 10051862 - DNA, 22 bp, Homo sapiens
cagtggctgagagtggacactg

SEQ ID NO: 10051863 - DNA, 20 bp, Homo sapiens
cagtggctgataacaaatta

SEQ ID NO: 10051864 - DNA, 22 bp, Homo sapiens
cagtggcttcttcctagagcca

SEQ ID NO: 10051865 - DNA, 22 bp, Homo sapiens
cagtggcttaaataagattagg

SEQ ID NO: 10051866 - DNA, 22 bp, Homo sapiens
cagttaaattctccagttacca

SEQ ID NO: 10051867 - DNA, 22 bp, Homo sapiens
tcagcagaagtatagaggccat

SEQ ID NO: 10051868 - DNA, 22 bp, Homo sapiens
cagttacatgctcatgtcatca

SEQ ID NO: 10051869 - DNA, 22 bp, Homo sapiens
tcagcagaatgtggcatgtcac

SEQ ID NO: 10051870 - DNA, 22 bp, Homo sapiens
tcagcagagctcaggctccagc

SEQ ID NO: 10051871 - DNA, 22 bp, Homo sapiens
tcagcagaggggaaggcatctg

SEQ ID NO: 10051872 - DNA, 22 bp, Homo sapiens
tcagcagatgatttccatacaa

SEQ ID NO: 10051873 - DNA, 22 bp, Homo sapiens
cagtttaacctatccattatgt

SEQ ID NO: 10051874 - DNA, 19 bp, Homo sapiens
cagtttaactaattttatc

SEQ ID NO: 10051875 - DNA, 22 bp, Homo sapiens
cagtttaagtagaactgagaat

SEQ ID NO: 10051876 - DNA, 22 bp, Homo sapiens
cataaaatggcttgttctttaa

SEQ ID NO: 10051877 - DNA, 22 bp, Homo sapiens
cataaaatggcttgttctttaa

SEQ ID NO: 10051878 - DNA, 22 bp, Homo sapiens
cataaagtaaagatgtcttcca

SEQ ID NO: 10051879 - DNA, 22 bp, Homo sapiens
cataaactcttgagattcttgt

SEQ ID NO: 10051880 - DNA, 22 bp, Homo sapiens
cagggtggggaaatagcgccct

SEQ ID NO: 10051881 - DNA, 22 bp, Homo sapiens
tatttccacctattattttctg

SEQ ID NO: 10051882 - DNA, 22 bp, Homo sapiens
tatttccaagctgaatccaatg

SEQ ID NO: 10051883 - DNA, 22 bp, Homo sapiens
tatttccaccctcagtaaggaa

SEQ ID NO: 10051884 - DNA, 22 bp, Homo sapiens
tatttccaaaagcctattatga

SEQ ID NO: 10051885 - DNA, 18 bp, Homo sapiens
cagtataaccagcaactc

SEQ ID NO: 10051886 - DNA, 22 bp, Homo sapiens
cagtcccaaggaggaagcagtc

SEQ ID NO: 10051887 - DNA, 22 bp, Homo sapiens
cagtcccaaggaggaagcagtc

SEQ ID NO: 10051888 - DNA, 20 bp, Homo sapiens
cagtccactggagttcctac

SEQ ID NO: 10051889 - DNA, 22 bp, Homo sapiens
tcacagttcaactagttcagat

SEQ ID NO: 10051890 - DNA, 22 bp, Homo sapiens
tcacagtttccataggtcagca

SEQ ID NO: 10051891 - DNA, 22 bp, Homo sapiens
tcacagttgattgaaacacagc

SEQ ID NO: 10051892 - DNA, 22 bp, Homo sapiens
tcacagttactccttcagatga

SEQ ID NO: 10051893 - DNA, 22 bp, Homo sapiens
tcacagcttcttgcgggtctga

SEQ ID NO: 10051894 - DNA, 22 bp, Homo sapiens
tcacagagaactataatccatc

SEQ ID NO: 10051895 - DNA, 21 bp, Homo sapiens
tcacagactggtcagtgaggc

SEQ ID NO: 10051896 - DNA, 22 bp, Homo sapiens
tcacagactcttgattgtctaa

SEQ ID NO: 10051897 - DNA, 22 bp, Homo sapiens
tcaatgagaaagacacagtctt

SEQ ID NO: 10051898 - DNA, 22 bp, Homo sapiens
tcaatgaggtgattgctgtcct

SEQ ID NO: 10051899 - DNA, 22 bp, Homo sapiens
tcaatgagccagaatgtagtac

SEQ ID NO: 10051900 - DNA, 22 bp, Homo sapiens
tcaatgagctggggacgtgtac

SEQ ID NO: 10051901 - DNA, 22 bp, Homo sapiens
tcaatgaggtaatcagtcaccc

SEQ ID NO: 10051902 - DNA, 22 bp, Homo sapiens
cagtgacgtaaactgcatgtgc

SEQ ID NO: 10051903 - DNA, 22 bp, Homo sapiens
tttttcatattcccctctctgg

SEQ ID NO: 10051904 - DNA, 22 bp, Homo sapiens
ttttcattgttactatgagcta

SEQ ID NO: 10051905 - DNA, 22 bp, Homo sapiens
ttttcttatggtgaagcacaaa

SEQ ID NO: 10051906 - DNA, 22 bp, Homo sapiens
ttttctcttgttaatgtactga

SEQ ID NO: 10051907 - DNA, 22 bp, Homo sapiens
ttttcattgttcctcgagcatt

SEQ ID NO: 10051908 - DNA, 22 bp, Homo sapiens
ttttaatgggcgactattatgg

SEQ ID NO: 10051909 - DNA, 22 bp, Homo sapiens
ttttaaatctccagttgacccc

SEQ ID NO: 10051910 - DNA, 22 bp, Homo sapiens
tttgtgttttagctggtgaggc

SEQ ID NO: 10051911 - DNA, 22 bp, Homo sapiens
tttgttaaggagtattgcttct

SEQ ID NO: 10051912 - DNA, 22 bp, Homo sapiens
tttgttataacaataaaaagtc

SEQ ID NO: 10051913 - DNA, 22 bp, Homo sapiens
tttgtgtggtggatactgggta

SEQ ID NO: 10051914 - DNA, 22 bp, Homo sapiens
tttgtgtgtatatgtatataga

SEQ ID NO: 10051915 - DNA, 22 bp, Homo sapiens
tttgaattattccttgagttga

SEQ ID NO: 10051916 - DNA, 22 bp, Homo sapiens
tttgaaaggaattaggatgaca

SEQ ID NO: 10051917 - DNA, 22 bp, Homo sapiens
tttgaaaaaggcctttggtatg

SEQ ID NO: 10051918 - DNA, 22 bp, Homo sapiens
tttgatatcctatacaagtaaa

SEQ ID NO: 10051919 - DNA, 22 bp, Homo sapiens
tttgatatcttggtatacagat

SEQ ID NO: 10051920 - DNA, 22 bp, Homo sapiens
tttggtaaccttgcattcttta

SEQ ID NO: 10051921 - DNA, 22 bp, Homo sapiens
tttggtaagtatgaatgcagta

SEQ ID NO: 10051922 - DNA, 22 bp, Homo sapiens
tttggtaagtcaggaatgcttc

SEQ ID NO: 10051923 - DNA, 22 bp, Homo sapiens
tttggtgatagtgcagagaaat

SEQ ID NO: 10051924 - DNA, 22 bp, Homo sapiens
tttggaaactgcctcagctctt

SEQ ID NO: 10051925 - DNA, 22 bp, Homo sapiens
tttggaaacacggtcatcttcc

SEQ ID NO: 10051926 - DNA, 22 bp, Homo sapiens
tttggaaacacggtcatcttcc

SEQ ID NO: 10051927 - DNA, 22 bp, Homo sapiens
tttggaaataattccatctcat

SEQ ID NO: 10051928 - DNA, 22 bp, Homo sapiens
tttggaaataattccatctcat

SEQ ID NO: 10051929 - DNA, 22 bp, Homo sapiens
tttggaaagttgtcactttaga

SEQ ID NO: 10051930 - DNA, 22 bp, Homo sapiens
ttcttcaaaatccagcatgatt

SEQ ID NO: 10051931 - DNA, 22 bp, Homo sapiens
ttcttcaaaatccagcatgatt

SEQ ID NO: 10051932 - DNA, 22 bp, Homo sapiens
ttcttcaaccatctacataaac

SEQ ID NO: 10051933 - DNA, 22 bp, Homo sapiens
ttcttttaatgtctggctttca

SEQ ID NO: 10051934 - DNA, 22 bp, Homo sapiens
ttcttttaatgttctgaagttt

SEQ ID NO: 10051935 - DNA, 22 bp, Homo sapiens
ttcttttcttggcaggagtaga

SEQ ID NO: 10051936 - DNA, 22 bp, Homo sapiens
ttgaaagggatatatctttctg

SEQ ID NO: 10051937 - DNA, 22 bp, Homo sapiens
ttgaaatgcagattccaatcca

SEQ ID NO: 10051938 - DNA, 22 bp, Homo sapiens
ttcttagatgattaatgatggg

SEQ ID NO: 10051939 - DNA, 22 bp, Homo sapiens
ttcttataagttaatatttcca

SEQ ID NO: 10051940 - DNA, 22 bp, Homo sapiens
ttctgtgtgcttactggtgttc

SEQ ID NO: 10051941 - DNA, 22 bp, Homo sapiens
ttctgtgtgccagagttgtgct

SEQ ID NO: 10051942 - DNA, 22 bp, Homo sapiens
ttctgtgtcttcttgttctgtg

SEQ ID NO: 10051943 - DNA, 22 bp, Homo sapiens
ttctgtgactcctcagagattt

SEQ ID NO: 10051944 - DNA, 22 bp, Homo sapiens
ttctgtgaatggccatgacaag

SEQ ID NO: 10051945 - DNA, 22 bp, Homo sapiens
ttctggagacccagcaacaggg

SEQ ID NO: 10051946 - DNA, 22 bp, Homo sapiens
ttctccaaggatacagtcctgt

SEQ ID NO: 10051947 - DNA, 22 bp, Homo sapiens
ttctccaatagctgctcatggc

SEQ ID NO: 10051948 - DNA, 22 bp, Homo sapiens
ttctcagatccatcagaagtcc

SEQ ID NO: 10051949 - DNA, 22 bp, Homo sapiens
ttcatttgttgacagagacatg

SEQ ID NO: 10051950 - DNA, 22 bp, Homo sapiens
ttcatttgccatcagtgtaatg

SEQ ID NO: 10051951 - DNA, 22 bp, Homo sapiens
ttcatttattcagcaggtattt

SEQ ID NO: 10051952 - DNA, 23 bp, Homo sapiens
ttcatttaggagttcataagagc

SEQ ID NO: 10051953 - DNA, 22 bp, Homo sapiens
ttcatttaatttgtgtattaac

SEQ ID NO: 10051954 - DNA, 22 bp, Homo sapiens
ttcatttagcatgctaaacctg

SEQ ID NO: 10051955 - DNA, 22 bp, Homo sapiens
ttcatttaatcagaatctctaa

SEQ ID NO: 10051956 - DNA, 22 bp, Homo sapiens
ttcattgcattccagcctgggt

SEQ ID NO: 10051957 - DNA, 22 bp, Homo sapiens
ttcattgatttccttggaataa

SEQ ID NO: 10051958 - DNA, 22 bp, Homo sapiens
ttcagtttgtttgactgttaga

SEQ ID NO: 10051959 - DNA, 22 bp, Homo sapiens
ttcagtttgctacaagcaacat

SEQ ID NO: 10051960 - DNA, 22 bp, Homo sapiens
ttcagttttccctcctgcaggt

SEQ ID NO: 10051961 - DNA, 22 bp, Homo sapiens
ttcagttttctttagaatgtag

SEQ ID NO: 10051962 - DNA, 22 bp, Homo sapiens
ttcagttttgcttttaatcatg

SEQ ID NO: 10051963 - DNA, 21 bp, Homo sapiens
ttcataaaccattctcatgca

SEQ ID NO: 10051964 - DNA, 22 bp, Homo sapiens
ttcacagagagtatgcagagaa

SEQ ID NO: 10051965 - DNA, 21 bp, Homo sapiens
ttcaaagacttgatgctgacc

SEQ ID NO: 10051966 - DNA, 22 bp, Homo sapiens
ttcaaagagttgggtgtctggg

SEQ ID NO: 10051967 - DNA, 22 bp, Homo sapiens
ttcaaagattagcatacgcaat

SEQ ID NO: 10051968 - DNA, 22 bp, Homo sapiens
ttcaaagattttcccaaagctc

SEQ ID NO: 10051969 - DNA, 22 bp, Homo sapiens
ttcaaagctgcagactcctggg

SEQ ID NO: 10051970 - DNA, 22 bp, Homo sapiens
ttcaaagataattaccaaacat

SEQ ID NO: 10051971 - DNA, 22 bp, Homo sapiens
ttcacaataggagcatgcaaat

SEQ ID NO: 10051972 - DNA, 22 bp, Homo sapiens
ttcagagacagcaaccaggaca

SEQ ID NO: 10051973 - DNA, 22 bp, Homo sapiens
ttcagagaagtgcacaaaatca

SEQ ID NO: 10051974 - DNA, 22 bp, Homo sapiens
ttcagagaagcaaaggcagatt

SEQ ID NO: 10051975 - DNA, 22 bp, Homo sapiens
ttcagagagaaaccagtgggaa

SEQ ID NO: 10051976 - DNA, 22 bp, Homo sapiens
ttcagagagtacagttgctggc

SEQ ID NO: 10051977 - DNA, 22 bp, Homo sapiens
ttcagagagaccaagtggcgtg

SEQ ID NO: 10051978 - DNA, 20 bp, Homo sapiens
ttcagagatagggtctttaa

SEQ ID NO: 10051979 - DNA, 22 bp, Homo sapiens
ttcagagagtttgtgagtcctt

SEQ ID NO: 10051980 - DNA, 22 bp, Homo sapiens
ttcagagagtccagtatgcagt

SEQ ID NO: 10051981 - DNA, 22 bp, Homo sapiens
ttcagagatgacacctggtgtt

SEQ ID NO: 10051982 - DNA, 22 bp, Homo sapiens
ttcagagatggaaggcagaatg

SEQ ID NO: 10051983 - DNA, 22 bp, Homo sapiens
ttcagagaacttcatggaagag

SEQ ID NO: 10051984 - DNA, 22 bp, Homo sapiens
ttcagagaagcaaaggcagatt

SEQ ID NO: 10051985 - DNA, 22 bp, Homo sapiens
ttcagagaaagcagatttactc

SEQ ID NO: 10051986 - DNA, 22 bp, Homo sapiens
ttaggaaagaagcagctaggag

SEQ ID NO: 10051987 - DNA, 22 bp, Homo sapiens
ttaggaaagggttttctaacag

SEQ ID NO: 10051988 - DNA, 22 bp, Homo sapiens
ttaggaaacgctgctattgact

SEQ ID NO: 10051989 - DNA, 22 bp, Homo sapiens
ttatagatttttatgaagtctg

SEQ ID NO: 10051990 - DNA, 22 bp, Homo sapiens
ttatactttatactacatcatt

SEQ ID NO: 10051991 - DNA, 22 bp, Homo sapiens
ttatactaaaacgcattgaatt

SEQ ID NO: 10051992 - DNA, 22 bp, Homo sapiens
ttatataactcaggtgggctca

SEQ ID NO: 10051993 - DNA, 22 bp, Homo sapiens
ttatataaagataacttttctt

SEQ ID NO: 10051994 - DNA, 22 bp, Homo sapiens
ttatataaagataacttttctt

SEQ ID NO: 10051995 - DNA, 22 bp, Homo sapiens
ttatataaagataacttttctt

SEQ ID NO: 10051996 - DNA, 22 bp, Homo sapiens
ttataggaaaagttctagaaaa

SEQ ID NO: 10051997 - DNA, 22 bp, Homo sapiens
tcctgctggaaacttcctcttg

SEQ ID NO: 10051998 - DNA, 22 bp, Homo sapiens
tcctgctgagcatgttctgccc

SEQ ID NO: 10051999 - DNA, 22 bp, Homo sapiens
tcctgctgctacctggcccacg

SEQ ID NO: 10052000 - DNA, 20 bp, Homo sapiens
tcctgctgccacctcttctt

SEQ ID NO: 10052001 - DNA, 22 bp, Homo sapiens
ttcaaacattcaaataaaccgg

SEQ ID NO: 10052002 - DNA, 22 bp, Homo sapiens
ttcaaacagttgcacaacttat

SEQ ID NO: 10052003 - DNA, 22 bp, Homo sapiens
ttcaaacagtgtagaatatatg

SEQ ID NO: 10052004 - DNA, 22 bp, Homo sapiens
ttcaaacacagacagcagcatg

SEQ ID NO: 10052005 - DNA, 22 bp, Homo sapiens
ttattctttaaacatatatgtt

SEQ ID NO: 10052006 - DNA, 22 bp, Homo sapiens
ttattagtgttgatattaggat

SEQ ID NO: 10052007 - DNA, 22 bp, Homo sapiens
ttattacaatgcagaaaataga

SEQ ID NO: 10052008 - DNA, 22 bp, Homo sapiens
ttattaagtgcgtactgtatgc

SEQ ID NO: 10052009 - DNA, 20 bp, Homo sapiens
ttatatcataatgtgccaat

SEQ ID NO: 10052010 - DNA, 22 bp, Homo sapiens
ttatatgagtatcatatcactt

SEQ ID NO: 10052011 - DNA, 22 bp, Homo sapiens
ttggccatctaagcccagccac

SEQ ID NO: 10052012 - DNA, 22 bp, Homo sapiens
ttgggacagcaaccatctgcta

SEQ ID NO: 10052013 - DNA, 22 bp, Homo sapiens
ttgggcagggaaaggacaggca

SEQ ID NO: 10052014 - DNA, 22 bp, Homo sapiens
ttggacagtgcagatctacacg

SEQ ID NO: 10052015 - DNA, 22 bp, Homo sapiens
ttggagagattatcagaccagc

SEQ ID NO: 10052016 - DNA, 22 bp, Homo sapiens
ttggagagaggctgctcaggct

SEQ ID NO: 10052017 - DNA, 22 bp, Homo sapiens
ttggagagaggctgctcaggct

SEQ ID NO: 10052018 - DNA, 22 bp, Homo sapiens
ttggagagatttaggtctcagt

SEQ ID NO: 10052019 - DNA, 22 bp, Homo sapiens
ttgtacacaattcttaacatac

SEQ ID NO: 10052020 - DNA, 22 bp, Homo sapiens
ttgtacagaaactgcatttgga

SEQ ID NO: 10052021 - DNA, 22 bp, Homo sapiens
ttgtacagaaaaaattcttggt

SEQ ID NO: 10052022 - DNA, 22 bp, Homo sapiens
ttgtacagaccctgaaaagctc

SEQ ID NO: 10052023 - DNA, 22 bp, Homo sapiens
ttgtacagattttcctcggtct

SEQ ID NO: 10052024 - DNA, 19 bp, Homo sapiens
ttgtacagcaaccaaccct

SEQ ID NO: 10052025 - DNA, 22 bp, Homo sapiens
ttgtacaggttcctagggtgga

SEQ ID NO: 10052026 - DNA, 22 bp, Homo sapiens
ttgtacagtttaagtgggtgaa

SEQ ID NO: 10052027 - DNA, 23 bp, Homo sapiens
ttgtacagcccagattcctcttc

SEQ ID NO: 10052028 - DNA, 22 bp, Homo sapiens
ttgtacagggaagtaatacaag

SEQ ID NO: 10052029 - DNA, 22 bp, Homo sapiens
ttgtatttcgatgcacgtgtag

SEQ ID NO: 10052030 - DNA, 22 bp, Homo sapiens
ttgtatttctccactttctgtt

SEQ ID NO: 10052031 - DNA, 22 bp, Homo sapiens
ttgtattttttcctggcggtgg

SEQ ID NO: 10052032 - DNA, 20 bp, Homo sapiens
ttgctgttgccaagattttg

SEQ ID NO: 10052033 - DNA, 22 bp, Homo sapiens
ttgctcatttgcctttaggttt

SEQ ID NO: 10052034 - DNA, 22 bp, Homo sapiens
ttgctcatatttgcatgtgttt

SEQ ID NO: 10052035 - DNA, 22 bp, Homo sapiens
ttgcttatttgattaaatgtct

SEQ ID NO: 10052036 - DNA, 22 bp, Homo sapiens
ttgctttatttggcatgccact

SEQ ID NO: 10052037 - DNA, 22 bp, Homo sapiens
ttggaaaggagattctattgtg

SEQ ID NO: 10052038 - DNA, 22 bp, Homo sapiens
ttggaaagcccattatttggac

SEQ ID NO: 10052039 - DNA, 22 bp, Homo sapiens
ttggacagaatttatcttcagt

SEQ ID NO: 10052040 - DNA, 22 bp, Homo sapiens
ttgacaagtggagatatttaag

SEQ ID NO: 10052041 - DNA, 22 bp, Homo sapiens
ttgcaattgctatggagagcgt

SEQ ID NO: 10052042 - DNA, 22 bp, Homo sapiens
ttgcaattagttacaaaagtgg

SEQ ID NO: 10052043 - DNA, 23 bp, Homo sapiens
ttgcatggagcctgggattcctc

SEQ ID NO: 10052044 - DNA, 22 bp, Homo sapiens
tttcattgaactaaagaatctg

SEQ ID NO: 10052045 - DNA, 21 bp, Homo sapiens
tttcagacctatctttgaagg

SEQ ID NO: 10052046 - DNA, 22 bp, Homo sapiens
tttcagactgctgtgtgaaact

SEQ ID NO: 10052047 - DNA, 22 bp, Homo sapiens
tttcagaaagcatcatcaaagt

SEQ ID NO: 10052048 - DNA, 22 bp, Homo sapiens
tttcagaaagcatcatcaaagt

SEQ ID NO: 10052049 - DNA, 22 bp, Homo sapiens
tttcagaaacgattatgaacac

SEQ ID NO: 10052050 - DNA, 22 bp, Homo sapiens
tttcagaaatcaaaaccagggt

SEQ ID NO: 10052051 - DNA, 22 bp, Homo sapiens
tttcagaaatcaaaaccagggt

SEQ ID NO: 10052052 - DNA, 22 bp, Homo sapiens
tttcagaaatggcactgaaatc

SEQ ID NO: 10052053 - DNA, 22 bp, Homo sapiens
tttcagaaatggcactgaaatc

SEQ ID NO: 10052054 - DNA, 22 bp, Homo sapiens
tttcacaattttaaggagcaaa

SEQ ID NO: 10052055 - DNA, 22 bp, Homo sapiens
tttcacactgcagcatcagaga

SEQ ID NO: 10052056 - DNA, 22 bp, Homo sapiens
tttcacagatcctacagcttgt

SEQ ID NO: 10052057 - DNA, 22 bp, Homo sapiens
tttcaaaggttttgtcatgtct

SEQ ID NO: 10052058 - DNA, 22 bp, Homo sapiens
tttattctataggcattaagca

SEQ ID NO: 10052059 - DNA, 22 bp, Homo sapiens
tttattctagctcagaatagtt

SEQ ID NO: 10052060 - DNA, 22 bp, Homo sapiens
tttattcttgagagtgagaaga

SEQ ID NO: 10052061 - DNA, 22 bp, Homo sapiens
tttattctgtgctacatgaaga

SEQ ID NO: 10052062 - DNA, 22 bp, Homo sapiens
tttatatttcccaggattggcc

SEQ ID NO: 10052063 - DNA, 22 bp, Homo sapiens
tttatattgtaaaaatggttct

SEQ ID NO: 10052064 - DNA, 22 bp, Homo sapiens
tttatattgggagtcgttttga

SEQ ID NO: 10052065 - DNA, 22 bp, Homo sapiens
tttatatagagatttgtgcatg

SEQ ID NO: 10052066 - DNA, 23 bp, Homo sapiens
tttatattcctaatgtcttgagc

SEQ ID NO: 10052067 - DNA, 22 bp, Homo sapiens
tttagcagcaaataagtagtgc

SEQ ID NO: 10052068 - DNA, 22 bp, Homo sapiens
tttagagagtgtaaaaatatat

SEQ ID NO: 10052069 - DNA, 22 bp, Homo sapiens
tttagaagttcacacatttaaa

SEQ ID NO: 10052070 - DNA, 20 bp, Homo sapiens
tttacattttgaaacagtga

SEQ ID NO: 10052071 - DNA, 22 bp, Homo sapiens
tttaaatgcagacgttgattca

SEQ ID NO: 10052072 - DNA, 22 bp, Homo sapiens
tttaaataggactcctgggggt

SEQ ID NO: 10052073 - DNA, 22 bp, Homo sapiens
tttaaatgtttatagagagtac

SEQ ID NO: 10052074 - DNA, 22 bp, Homo sapiens
tttaaatgtgttcttagtagct

SEQ ID NO: 10052075 - DNA, 17 bp, Homo sapiens
tttaaactactacaagg

SEQ ID NO: 10052076 - DNA, 22 bp, Homo sapiens
tttaaagaaattcctcatcttt

SEQ ID NO: 10052077 - DNA, 22 bp, Homo sapiens
ttgtgtgtagactcagccattg

SEQ ID NO: 10052078 - DNA, 22 bp, Homo sapiens
ttgtgtgtactggttatgggca

SEQ ID NO: 10052079 - DNA, 22 bp, Homo sapiens
tttaaacatcttgttgccttaa

SEQ ID NO: 10052080 - DNA, 22 bp, Homo sapiens
tttaaacatatctgttgaggga

SEQ ID NO: 10052081 - DNA, 17 bp, Homo sapiens
ttgtgtgtagttctgat

SEQ ID NO: 10052082 - DNA, 23 bp, Homo sapiens
tttaatgaccaatagaaggaaca

SEQ ID NO: 10052083 - DNA, 22 bp, Homo sapiens
tttaatgatagctgtttcacat

SEQ ID NO: 10052084 - DNA, 22 bp, Homo sapiens
cttgaggttttgactcagcttt

SEQ ID NO: 10052085 - DNA, 22 bp, Homo sapiens
cttgagctaggaaggctgaggc

SEQ ID NO: 10052086 - DNA, 18 bp, Homo sapiens
cttgagctaagggacccc

SEQ ID NO: 10052087 - DNA, 22 bp, Homo sapiens
atgaatgaataccatgcaacta

SEQ ID NO: 10052088 - DNA, 22 bp, Homo sapiens
atgaatgaaatacagagtactt

SEQ ID NO: 10052089 - DNA, 20 bp, Homo sapiens
gaaaataggccagccaggta

SEQ ID NO: 10052090 - DNA, 22 bp, Homo sapiens
gaaaatgagcctcagctacatt

SEQ ID NO: 10052091 - DNA, 22 bp, Homo sapiens
gaaaagaactgcatgggattaa

SEQ ID NO: 10052092 - DNA, 22 bp, Homo sapiens
gaaaactgtgattagaatgcct

SEQ ID NO: 10052093 - DNA, 22 bp, Homo sapiens
gaaaactaacggaaaagttagg

SEQ ID NO: 10052094 - DNA, 22 bp, Homo sapiens
gaaaactattggcctagaacaa

SEQ ID NO: 10052095 - DNA, 21 bp, Homo sapiens
gaaaaccatttgcatcatgag

SEQ ID NO: 10052096 - DNA, 22 bp, Homo sapiens
gaaaaccacctcccatcaagca

SEQ ID NO: 10052097 - DNA, 22 bp, Homo sapiens
atgaatgattaaagagtacagt

SEQ ID NO: 10052098 - DNA, 22 bp, Homo sapiens
atgaatgatgcaaaagacactg

SEQ ID NO: 10052099 - DNA, 22 bp, Homo sapiens
atgaatgagattaccaatgtga

SEQ ID NO: 10052100 - DNA, 22 bp, Homo sapiens
atgaatgattttatgtaaatga

SEQ ID NO: 10052101 - DNA, 22 bp, Homo sapiens
atgaatgatttgtcagtcacag

SEQ ID NO: 10052102 - DNA, 21 bp, Homo sapiens
atgaatgatttctactcttaa

SEQ ID NO: 10052103 - DNA, 22 bp, Homo sapiens
gaacataattaaatgtcctggg

SEQ ID NO: 10052104 - DNA, 22 bp, Homo sapiens
gaacataactattgtgaatagt

SEQ ID NO: 10052105 - DNA, 22 bp, Homo sapiens
gaaatatacatgaagtcggctg

SEQ ID NO: 10052106 - DNA, 22 bp, Homo sapiens
gaaatctgaacaacagctgtca

SEQ ID NO: 10052107 - DNA, 22 bp, Homo sapiens
atgcaatttactgtacataaat

SEQ ID NO: 10052108 - DNA, 22 bp, Homo sapiens
atgcaataccttctgaaaataa

SEQ ID NO: 10052109 - DNA, 22 bp, Homo sapiens
atgcaaatgaacatgttgctag

SEQ ID NO: 10052110 - DNA, 23 bp, Homo sapiens
atgcaagagtttctcaaactgga

SEQ ID NO: 10052111 - DNA, 22 bp, Homo sapiens
gaacattcctggaagagtgctt

SEQ ID NO: 10052112 - DNA, 22 bp, Homo sapiens
gaactttaccatttaggtaact

SEQ ID NO: 10052113 - DNA, 22 bp, Homo sapiens
gaatgtccctgcagttgctgcc

SEQ ID NO: 10052114 - DNA, 22 bp, Homo sapiens
atgcctggactgacatgcactg

SEQ ID NO: 10052115 - DNA, 22 bp, Homo sapiens
atgctttattattttgcaggga

SEQ ID NO: 10052116 - DNA, 22 bp, Homo sapiens
atgctttatgttctggcatttt

SEQ ID NO: 10052117 - DNA, 19 bp, Homo sapiens
atgctttatgttatttctt

SEQ ID NO: 10052118 - DNA, 22 bp, Homo sapiens
gactttggagcagaaagaaatt

SEQ ID NO: 10052119 - DNA, 22 bp, Homo sapiens
atgctttgaagtttttcctcat

SEQ ID NO: 10052120 - DNA, 22 bp, Homo sapiens
atgctttctcttagttcattga

SEQ ID NO: 10052121 - DNA, 22 bp, Homo sapiens
atgcttttccaggagaaatata

SEQ ID NO: 10052122 - DNA, 22 bp, Homo sapiens
atgcttttaactcctttatccc

SEQ ID NO: 10052123 - DNA, 22 bp, Homo sapiens
atgcttttaactcctttatccc

SEQ ID NO: 10052124 - DNA, 22 bp, Homo sapiens
gacagtggttccaaggcagctt

SEQ ID NO: 10052125 - DNA, 22 bp, Homo sapiens
gacagtttaggttcaaatctca

SEQ ID NO: 10052126 - DNA, 22 bp, Homo sapiens
gacataaaattcaataatttgt

SEQ ID NO: 10052127 - DNA, 22 bp, Homo sapiens
gacataaaatggaattctgttg

SEQ ID NO: 10052128 - DNA, 22 bp, Homo sapiens
gacataaaccttgagatattaa

SEQ ID NO: 10052129 - DNA, 22 bp, Homo sapiens
atgcttggcagagttctttttc

SEQ ID NO: 10052130 - DNA, 22 bp, Homo sapiens
atgctttagtgtcaagtttggg

SEQ ID NO: 10052131 - DNA, 22 bp, Homo sapiens
atgctttacagttttccaaaca

SEQ ID NO: 10052132 - DNA, 22 bp, Homo sapiens
atgctttttaaacttaattgga

SEQ ID NO: 10052133 - DNA, 22 bp, Homo sapiens
gagaggctctgaggactggggt

SEQ ID NO: 10052134 - DNA, 22 bp, Homo sapiens
gagcctgggactgggggtcatg

SEQ ID NO: 10052135 - DNA, 23 bp, Homo sapiens
gagctctgcactaggccctggga

SEQ ID NO: 10052136 - DNA, 22 bp, Homo sapiens
gagctttgatcgctaagcctca

SEQ ID NO: 10052137 - DNA, 22 bp, Homo sapiens
atgtaaagtaatctgtcgatca

SEQ ID NO: 10052138 - DNA, 22 bp, Homo sapiens
atgtaattgtagcaaaatgatg

SEQ ID NO: 10052139 - DNA, 22 bp, Homo sapiens
gagtccaggctcagaaacccgt

SEQ ID NO: 10052140 - DNA, 22 bp, Homo sapiens
gagggggcgtgcaaggctccgc

SEQ ID NO: 10052141 - DNA, 22 bp, Homo sapiens
gagggggctccctgaagccagt

SEQ ID NO: 10052142 - DNA, 22 bp, Homo sapiens
gagggggctagcgcagtgccca

SEQ ID NO: 10052143 - DNA, 22 bp, Homo sapiens
gagggggtctatgaggtagagc

SEQ ID NO: 10052144 - DNA, 22 bp, Homo sapiens
gagggggctctgccaacctgtc

SEQ ID NO: 10052145 - DNA, 22 bp, Homo sapiens
gagtccagtagttaggacagag

SEQ ID NO: 10052146 - DNA, 22 bp, Homo sapiens
gagtccagttagtgaggctggg

SEQ ID NO: 10052147 - DNA, 22 bp, Homo sapiens
gagtccagttctttccagcagt

SEQ ID NO: 10052148 - DNA, 22 bp, Homo sapiens
gagtccagttagtgaggctggg

SEQ ID NO: 10052149 - DNA, 22 bp, Homo sapiens
gagtccagtgtttaccaggggt

SEQ ID NO: 10052150 - DNA, 22 bp, Homo sapiens
gagtgcaggcctgagcaccatc

SEQ ID NO: 10052151 - DNA, 21 bp, Homo sapiens
gagtgcagcaaggtagagtct

SEQ ID NO: 10052152 - DNA, 22 bp, Homo sapiens
atgtttcatttagatatcaggc

SEQ ID NO: 10052153 - DNA, 22 bp, Homo sapiens
atgtttatgttgggctatattt

SEQ ID NO: 10052154 - DNA, 22 bp, Homo sapiens
atgtttcaccagcaaattacct

SEQ ID NO: 10052155 - DNA, 22 bp, Homo sapiens
atgtttcaaatatatagagttg

SEQ ID NO: 10052156 - DNA, 18 bp, Homo sapiens
gatcgggggcgccccaag

SEQ ID NO: 10052157 - DNA, 22 bp, Homo sapiens
gatatttacaaatttgccaata

SEQ ID NO: 10052158 - DNA, 22 bp, Homo sapiens
gatatttaactctcacaggtcc

SEQ ID NO: 10052159 - DNA, 17 bp, Homo sapiens
gctccttctaacttcca

SEQ ID NO: 10052160 - DNA, 22 bp, Homo sapiens
gctcggtggccagcctgaggcc

SEQ ID NO: 10052161 - DNA, 22 bp, Homo sapiens
gctacacaatagcgttcactta

SEQ ID NO: 10052162 - DNA, 22 bp, Homo sapiens
gctacacaatagcgttcactta

SEQ ID NO: 10052163 - DNA, 22 bp, Homo sapiens
gctaataattcctttgtgaact

SEQ ID NO: 10052164 - DNA, 22 bp, Homo sapiens
gctattcatggagcatgtactg

SEQ ID NO: 10052165 - DNA, 22 bp, Homo sapiens
gctcaaagaccagacagaggag

SEQ ID NO: 10052166 - DNA, 22 bp, Homo sapiens
gctatttttgagccatttataa

SEQ ID NO: 10052167 - DNA, 22 bp, Homo sapiens
gctctgagacagtagagatggc

SEQ ID NO: 10052168 - DNA, 22 bp, Homo sapiens
caaattaccctcaacatctaga

SEQ ID NO: 10052169 - DNA, 22 bp, Homo sapiens
gctgagctgggacagtcctggg

SEQ ID NO: 10052170 - DNA, 22 bp, Homo sapiens
gcctgcccacggggctggcata

SEQ ID NO: 10052171 - DNA, 22 bp, Homo sapiens
attttgaaaccaagttatttcc

SEQ ID NO: 10052172 - DNA, 22 bp, Homo sapiens
attttcttctctccctggctgc

SEQ ID NO: 10052173 - DNA, 18 bp, Homo sapiens
attttgaacaatgctgta

SEQ ID NO: 10052174 - DNA, 22 bp, Homo sapiens
atttcttccttctcctagaaga

SEQ ID NO: 10052175 - DNA, 22 bp, Homo sapiens
atttgcataaggatgctactgt

SEQ ID NO: 10052176 - DNA, 22 bp, Homo sapiens
atttgcaaagtcgtatctgtga

SEQ ID NO: 10052177 - DNA, 22 bp, Homo sapiens
atttgcaaagtcgtatctgtga

SEQ ID NO: 10052178 - DNA, 22 bp, Homo sapiens
atttgcatatctgatagactaa

SEQ ID NO: 10052179 - DNA, 20 bp, Homo sapiens
atttgcatctgaataactta

SEQ ID NO: 10052180 - DNA, 22 bp, Homo sapiens
atttgcatgacctttgcaagtg

SEQ ID NO: 10052181 - DNA, 21 bp, Homo sapiens
atttgcattaaaatattacgc

SEQ ID NO: 10052182 - DNA, 22 bp, Homo sapiens
atttgcatttacatagcataga

SEQ ID NO: 10052183 - DNA, 22 bp, Homo sapiens
atttgcatttagaaagatcact

SEQ ID NO: 10052184 - DNA, 22 bp, Homo sapiens
gcccagcaggggatggcagctc

SEQ ID NO: 10052185 - DNA, 18 bp, Homo sapiens
gccagaggtactactgat

SEQ ID NO: 10052186 - DNA, 22 bp, Homo sapiens
gccagagggattcctggtgtgt

SEQ ID NO: 10052187 - DNA, 22 bp, Homo sapiens
atttcttcctctgtcagtaact

SEQ ID NO: 10052188 - DNA, 22 bp, Homo sapiens
gcactgtgacagcaagagtgag

SEQ ID NO: 10052189 - DNA, 22 bp, Homo sapiens
gcactgtgacccagagcaggtg

SEQ ID NO: 10052190 - DNA, 22 bp, Homo sapiens
gcagatcaattgattgttcact

SEQ ID NO: 10052191 - DNA, 22 bp, Homo sapiens
gcagatcaacactctctttcaa

SEQ ID NO: 10052192 - DNA, 22 bp, Homo sapiens
gcagatgcagagatggctgggg

SEQ ID NO: 10052193 - DNA, 22 bp, Homo sapiens
gcagccaggaagcccaggacac

SEQ ID NO: 10052194 - DNA, 22 bp, Homo sapiens
gcagccagggagagaaccaggg

SEQ ID NO: 10052195 - DNA, 19 bp, Homo sapiens
gcagccaggtgctctacct

SEQ ID NO: 10052196 - DNA, 22 bp, Homo sapiens
gcagccaggggctgtgacctgt

SEQ ID NO: 10052197 - DNA, 22 bp, Homo sapiens
gcagccttggttgtgagatgaa

SEQ ID NO: 10052198 - DNA, 22 bp, Homo sapiens
gcaaaaaatgcttgttgcttag

SEQ ID NO: 10052199 - DNA, 22 bp, Homo sapiens
atgtttctcactgtttctctat

SEQ ID NO: 10052200 - DNA, 22 bp, Homo sapiens
gcaaaatttacactccttcttc

SEQ ID NO: 10052201 - DNA, 22 bp, Homo sapiens
gcaaacaagctgcctgaagatt

SEQ ID NO: 10052202 - DNA, 22 bp, Homo sapiens
gcacacaggcagtttccagcca

SEQ ID NO: 10052203 - DNA, 20 bp, Homo sapiens
gcacagagatgagcaaagta

SEQ ID NO: 10052204 - DNA, 22 bp, Homo sapiens
gcaaatgctctccagcctgggt

SEQ ID NO: 10052205 - DNA, 22 bp, Homo sapiens
gcaaacaagctgcctgaagatt

SEQ ID NO: 10052206 - DNA, 22 bp, Homo sapiens
gcacagagcctggtaccgagaa

SEQ ID NO: 10052207 - DNA, 23 bp, Homo sapiens
gcacagagcagttaggggaagat

SEQ ID NO: 10052208 - DNA, 22 bp, Homo sapiens
gcactggggtcatagcctccag

SEQ ID NO: 10052209 - DNA, 22 bp, Homo sapiens
gcactgtgaatatactagcaaa

SEQ ID NO: 10052210 - DNA, 22 bp, Homo sapiens
gccactgtactccagcctgcga

SEQ ID NO: 10052211 - DNA, 22 bp, Homo sapiens
atttaaatgcttaagagggttt

SEQ ID NO: 10052212 - DNA, 18 bp, Homo sapiens
gcattcagtagtgaacaa

SEQ ID NO: 10052213 - DNA, 22 bp, Homo sapiens
gcattcagcctaaagagaaaag

SEQ ID NO: 10052214 - DNA, 22 bp, Homo sapiens
gccactgagcccggccattgtt

SEQ ID NO: 10052215 - DNA, 22 bp, Homo sapiens
gccaccttccaaaataatcaca

SEQ ID NO: 10052216 - DNA, 22 bp, Homo sapiens
gcagtgctgatcccatggcaga

SEQ ID NO: 10052217 - DNA, 20 bp, Homo sapiens
gcagtgctggtgcctctgct

SEQ ID NO: 10052218 - DNA, 18 bp, Homo sapiens
attgttaatagagtactt

SEQ ID NO: 10052219 - DNA, 22 bp, Homo sapiens
attgttaatgttgcactaaggt

SEQ ID NO: 10052220 - DNA, 22 bp, Homo sapiens
gcaggatggtggaaggcctgct

SEQ ID NO: 10052221 - DNA, 22 bp, Homo sapiens
gcaggcggaggttgcagtgagc

SEQ ID NO: 10052222 - DNA, 22 bp, Homo sapiens
gcaggctgtgaggctcagatgg

SEQ ID NO: 10052223 - DNA, 22 bp, Homo sapiens
gcagggactgtgatctcacaga

SEQ ID NO: 10052224 - DNA, 22 bp, Homo sapiens
attgtaaatagtgccacaataa

SEQ ID NO: 10052225 - DNA, 22 bp, Homo sapiens
ggctgggagctggacaggccgg

SEQ ID NO: 10052226 - DNA, 23 bp, Homo sapiens
cagaacagtaaaagatgccatgg

SEQ ID NO: 10052227 - DNA, 22 bp, Homo sapiens
cagaacagtacctagcacatag

SEQ ID NO: 10052228 - DNA, 22 bp, Homo sapiens
cagaacagaagtaaaatttacc

SEQ ID NO: 10052229 - DNA, 22 bp, Homo sapiens
cagaacagaaacgttgttccat

SEQ ID NO: 10052230 - DNA, 22 bp, Homo sapiens
cagaacacaggctaaactgaga

SEQ ID NO: 10052231 - DNA, 22 bp, Homo sapiens
ggctggctttctctccgcacct

SEQ ID NO: 10052232 - DNA, 22 bp, Homo sapiens
ggctgggagccccacagagtca

SEQ ID NO: 10052233 - DNA, 23 bp, Homo sapiens
ggctgggagctccgggtgcacgt

SEQ ID NO: 10052234 - DNA, 19 bp, Homo sapiens
ggctgctggttacagaggc

SEQ ID NO: 10052235 - DNA, 22 bp, Homo sapiens
ggcgccgcactcggtgcagccg

SEQ ID NO: 10052236 - DNA, 22 bp, Homo sapiens
ggctccagtttccccttggggc

SEQ ID NO: 10052237 - DNA, 21 bp, Homo sapiens
cactgaggtcaggggtagggt

SEQ ID NO: 10052238 - DNA, 22 bp, Homo sapiens
ggctcctgtcccctcagctgct

SEQ ID NO: 10052239 - DNA, 22 bp, Homo sapiens
ggctcctgtggcaagacagctt

SEQ ID NO: 10052240 - DNA, 19 bp, Homo sapiens
ggctcctgtggctgcagcc

SEQ ID NO: 10052241 - DNA, 22 bp, Homo sapiens
ggctgctcaaggactctgatcg

SEQ ID NO: 10052242 - DNA, 19 bp, Homo sapiens
cactgtcctagtcgaggcc

SEQ ID NO: 10052243 - DNA, 22 bp, Homo sapiens
ggctgcagccctcgcctagcca

SEQ ID NO: 10052244 - DNA, 22 bp, Homo sapiens
ggctgcagatagccagccacca

SEQ ID NO: 10052245 - DNA, 22 bp, Homo sapiens
cacccaggcaggtggctgagaa

SEQ ID NO: 10052246 - DNA, 22 bp, Homo sapiens
ggccagctcagggtccttgggc

SEQ ID NO: 10052247 - DNA, 22 bp, Homo sapiens
ggccactgtttcctgggcagtt

SEQ ID NO: 10052248 - DNA, 20 bp, Homo sapiens
caccacagaattggggacag

SEQ ID NO: 10052249 - DNA, 22 bp, Homo sapiens
caccacagcatccactagaagg

SEQ ID NO: 10052250 - DNA, 22 bp, Homo sapiens
caccaccaggcaggacaccgaa

SEQ ID NO: 10052251 - DNA, 22 bp, Homo sapiens
ggccccaggcctttggtctggc

SEQ ID NO: 10052252 - DNA, 22 bp, Homo sapiens
ggccccaggacctccacggtcc

SEQ ID NO: 10052253 - DNA, 22 bp, Homo sapiens
ggccccagcttcaaccccgtgg

SEQ ID NO: 10052254 - DNA, 22 bp, Homo sapiens
ggccccagctgtggtgaataga

SEQ ID NO: 10052255 - DNA, 22 bp, Homo sapiens
ggccccagcctcagtcccctga

SEQ ID NO: 10052256 - DNA, 22 bp, Homo sapiens
ggccccagggattaggccaacc

SEQ ID NO: 10052257 - DNA, 22 bp, Homo sapiens
ggccccagggaagaaggtggtc

SEQ ID NO: 10052258 - DNA, 22 bp, Homo sapiens
ggcccagaatactttgtaaaat

SEQ ID NO: 10052259 - DNA, 22 bp, Homo sapiens
ggcccagcacagtgcttggggg

SEQ ID NO: 10052260 - DNA, 19 bp, Homo sapiens
ggccccagccagggtatca

SEQ ID NO: 10052261 - DNA, 22 bp, Homo sapiens
ggccccagcagtgcttgtttat

SEQ ID NO: 10052262 - DNA, 22 bp, Homo sapiens
ggccccagcagaccctcctctg

SEQ ID NO: 10052263 - DNA, 21 bp, Homo sapiens
ggccccagcccatgggttctc

SEQ ID NO: 10052264 - DNA, 22 bp, Homo sapiens
ggccccagcctcagtcccctga

SEQ ID NO: 10052265 - DNA, 21 bp, Homo sapiens
ggccccagcccatgggttctc

SEQ ID NO: 10052266 - DNA, 22 bp, Homo sapiens
cacatgcagttttccagcagtc

SEQ ID NO: 10052267 - DNA, 22 bp, Homo sapiens
cacatgcataaggataattact

SEQ ID NO: 10052268 - DNA, 22 bp, Homo sapiens
cacatgcatacctatgtgtata

SEQ ID NO: 10052269 - DNA, 22 bp, Homo sapiens
cacatgcatcacgacttccttt

SEQ ID NO: 10052270 - DNA, 22 bp, Homo sapiens
cacatgcatctgtcatgtttgg

SEQ ID NO: 10052271 - DNA, 22 bp, Homo sapiens
cacatgcattggcaaaagtgta

SEQ ID NO: 10052272 - DNA, 22 bp, Homo sapiens
ggcaggactcttctgtgggccg

SEQ ID NO: 10052273 - DNA, 22 bp, Homo sapiens
cacatgcagtttacgtcactga

SEQ ID NO: 10052274 - DNA, 20 bp, Homo sapiens
ggcaggaccccagtggcatc

SEQ ID NO: 10052275 - DNA, 22 bp, Homo sapiens
cacatttcttatggatgttggc

SEQ ID NO: 10052276 - DNA, 22 bp, Homo sapiens
cacatttctggaattgacttgg

SEQ ID NO: 10052277 - DNA, 22 bp, Homo sapiens
cacatttctggaattgacttgg

SEQ ID NO: 10052278 - DNA, 22 bp, Homo sapiens
cacatgctagaataaatctcca

SEQ ID NO: 10052279 - DNA, 22 bp, Homo sapiens
ggcaggtgccttctgtgctagc

SEQ ID NO: 10052280 - DNA, 22 bp, Homo sapiens
ggaggtggaggttgcagtgagc

SEQ ID NO: 10052281 - DNA, 22 bp, Homo sapiens
ggatagtgggagaatgctatgt

SEQ ID NO: 10052282 - DNA, 22 bp, Homo sapiens
gctgggagccccgagccagcgc

SEQ ID NO: 10052283 - DNA, 22 bp, Homo sapiens
gctgggagcaaagccatgcata

SEQ ID NO: 10052284 - DNA, 22 bp, Homo sapiens
gctgggaggaatttggggaata

SEQ ID NO: 10052285 - DNA, 22 bp, Homo sapiens
gctgggagccctggtctgctcc

SEQ ID NO: 10052286 - DNA, 22 bp, Homo sapiens
caaatttaggtaacagtctgta

SEQ ID NO: 10052287 - DNA, 22 bp, Homo sapiens
caaatttaagttagaaagcaat

SEQ ID NO: 10052288 - DNA, 22 bp, Homo sapiens
caaattgtgtttgcttttctct

SEQ ID NO: 10052289 - DNA, 22 bp, Homo sapiens
caaattcctcagaatcagaaaa

SEQ ID NO: 10052290 - DNA, 20 bp, Homo sapiens
gctggcagatgtcttgagat

SEQ ID NO: 10052291 - DNA, 22 bp, Homo sapiens
caagtggggcagattctcttcc

SEQ ID NO: 10052292 - DNA, 22 bp, Homo sapiens
gctggtgtctaacctggctctt

SEQ ID NO: 10052293 - DNA, 22 bp, Homo sapiens
caatgtactacaaagattgtca

SEQ ID NO: 10052294 - DNA, 22 bp, Homo sapiens
caatgcttctcattagccaatg

SEQ ID NO: 10052295 - DNA, 22 bp, Homo sapiens
ggaaatgtaatcacagagggtt

SEQ ID NO: 10052296 - DNA, 22 bp, Homo sapiens
ggaaatgtgggctgtttctgta

SEQ ID NO: 10052297 - DNA, 19 bp, Homo sapiens
ggaaatgtggaaacatcct

SEQ ID NO: 10052298 - DNA, 22 bp, Homo sapiens
cacagagaatgatgagtcactg

SEQ ID NO: 10052299 - DNA, 22 bp, Homo sapiens
cacagagaatactgctcttgct

SEQ ID NO: 10052300 - DNA, 22 bp, Homo sapiens
cacagagaactgtgggagtgtg

SEQ ID NO: 10052301 - DNA, 22 bp, Homo sapiens
cacagagaactgtgggagtgtg

SEQ ID NO: 10052302 - DNA, 22 bp, Homo sapiens
cacagagaactgtgggagtgtg

SEQ ID NO: 10052303 - DNA, 22 bp, Homo sapiens
cacagagaccccttctggggcc

SEQ ID NO: 10052304 - DNA, 22 bp, Homo sapiens
cacagagacatgatgtcattgc

SEQ ID NO: 10052305 - DNA, 22 bp, Homo sapiens
cacagagacagatctattttgc

SEQ ID NO: 10052306 - DNA, 22 bp, Homo sapiens
cacagagacagaagcacttatg

SEQ ID NO: 10052307 - DNA, 22 bp, Homo sapiens
cacagagaattcccatatgtga

SEQ ID NO: 10052308 - DNA, 22 bp, Homo sapiens
ggacaacatgttttaattaagg

SEQ ID NO: 10052309 - DNA, 22 bp, Homo sapiens
ggacacaaaagtgaataaaata

SEQ ID NO: 10052310 - DNA, 22 bp, Homo sapiens
ggacagagggttgacagagtat

SEQ ID NO: 10052311 - DNA, 22 bp, Homo sapiens
ggaacaggaaaggagggatgct

SEQ ID NO: 10052312 - DNA, 22 bp, Homo sapiens
ggagcagcttgcatgctcaggg

SEQ ID NO: 10052313 - DNA, 22 bp, Homo sapiens
cacagcagtctttcactaaata

SEQ ID NO: 10052314 - DNA, 22 bp, Homo sapiens
ggagcagcactgccacacagag

SEQ ID NO: 10052315 - DNA, 22 bp, Homo sapiens
ggagcagccacgtctcagggca

SEQ ID NO: 10052316 - DNA, 22 bp, Homo sapiens
ggagcagccacgtctcagggca

SEQ ID NO: 10052317 - DNA, 22 bp, Homo sapiens
ggagcagccgcgtctcagggca

SEQ ID NO: 10052318 - DNA, 22 bp, Homo sapiens
ggagcagccgcgtctcagggca

SEQ ID NO: 10052319 - DNA, 22 bp, Homo sapiens
ggagcagcctgtgtagacgggg

SEQ ID NO: 10052320 - DNA, 22 bp, Homo sapiens
cacagcctttagggtacacaca

SEQ ID NO: 10052321 - DNA, 22 bp, Homo sapiens
cacagctaggaggaaagcagag

SEQ ID NO: 10052322 - DNA, 22 bp, Homo sapiens
ggaggggcagccatggaactcc

SEQ ID NO: 10052323 - DNA, 22 bp, Homo sapiens
ggaggggccggctgcctgccac

SEQ ID NO: 10052324 - DNA, 18 bp, Homo sapiens
cacaggagatgacctgac

SEQ ID NO: 10052325 - DNA, 16 bp, Homo sapiens
cagagtgtaaacagga

SEQ ID NO: 10052326 - DNA, 22 bp, Homo sapiens
ggggtccctgcaccagcatgtc

SEQ ID NO: 10052327 - DNA, 22 bp, Homo sapiens
ggggtctcactatgttacccag

SEQ ID NO: 10052328 - DNA, 22 bp, Homo sapiens
ggggtcctggaggccagctgga

SEQ ID NO: 10052329 - DNA, 22 bp, Homo sapiens
cagaggctgatgtgggatgggc

SEQ ID NO: 10052330 - DNA, 22 bp, Homo sapiens
ggtgcacttcttgctagtcttt

SEQ ID NO: 10052331 - DNA, 22 bp, Homo sapiens
cagcactctggcttcgttaagt

SEQ ID NO: 10052332 - DNA, 22 bp, Homo sapiens
ggtgggacaggtaggagtggct

SEQ ID NO: 10052333 - DNA, 22 bp, Homo sapiens
ggtgggacaggtaggagtggct

SEQ ID NO: 10052334 - DNA, 22 bp, Homo sapiens
ggtggctggaggagctgatgga

SEQ ID NO: 10052335 - DNA, 22 bp, Homo sapiens
cagatggcaacagctctgtgac

SEQ ID NO: 10052336 - DNA, 22 bp, Homo sapiens
ggtggcagtagcactgggcctg

SEQ ID NO: 10052337 - DNA, 22 bp, Homo sapiens
ggtggcagtgcttgcgggtcta

SEQ ID NO: 10052338 - DNA, 22 bp, Homo sapiens
cagcagaagtgcatttgtgatt

SEQ ID NO: 10052339 - DNA, 22 bp, Homo sapiens
cagcagagaaattacatatttg

SEQ ID NO: 10052340 - DNA, 22 bp, Homo sapiens
ggtgtctggacagtgagccagg

SEQ ID NO: 10052341 - DNA, 22 bp, Homo sapiens
cagagctgtcatttgccagtga

SEQ ID NO: 10052342 - DNA, 22 bp, Homo sapiens
gggggagctgttattggcaggg

SEQ ID NO: 10052343 - DNA, 23 bp, Homo sapiens
gggggagctggactcctagatcc

SEQ ID NO: 10052344 - DNA, 22 bp, Homo sapiens
gggggagctagtccagctgagg

SEQ ID NO: 10052345 - DNA, 22 bp, Homo sapiens
ggggcggggctctgagaagcat

SEQ ID NO: 10052346 - DNA, 22 bp, Homo sapiens
ggggcgccccgagggtgcgcac

SEQ ID NO: 10052347 - DNA, 22 bp, Homo sapiens
cagaagagtagctgaacaagtt

SEQ ID NO: 10052348 - DNA, 22 bp, Homo sapiens
cagaagcaaatgccttgctgag

SEQ ID NO: 10052349 - DNA, 22 bp, Homo sapiens
cagaagcaagagccggagctag

SEQ ID NO: 10052350 - DNA, 22 bp, Homo sapiens
cagaagcaagggccaaagtctt

SEQ ID NO: 10052351 - DNA, 22 bp, Homo sapiens
cagaagcaagtagtgattcttt

SEQ ID NO: 10052352 - DNA, 22 bp, Homo sapiens
cagaagcagattctaaagcaag

SEQ ID NO: 10052353 - DNA, 22 bp, Homo sapiens
cagaagcagaacactagattta

SEQ ID NO: 10052354 - DNA, 23 bp, Homo sapiens
cagaagcacctgttgactgctgc

SEQ ID NO: 10052355 - DNA, 22 bp, Homo sapiens
cagagacatccatgttagttgg

SEQ ID NO: 10052356 - DNA, 20 bp, Homo sapiens
cagagacctgtcttcacaga

SEQ ID NO: 10052357 - DNA, 22 bp, Homo sapiens
cagagagaatatgtagtatgga

SEQ ID NO: 10052358 - DNA, 22 bp, Homo sapiens
cagagagaggtgccgataatgg

SEQ ID NO: 10052359 - DNA, 22 bp, Homo sapiens
cagagagagtcaaatctttgct

SEQ ID NO: 10052360 - DNA, 22 bp, Homo sapiens
cagagagaggggctgcctggcc

SEQ ID NO: 10052361 - DNA, 22 bp, Homo sapiens
cagagagaggccactgctatta

SEQ ID NO: 10052362 - DNA, 22 bp, Homo sapiens
cagagagaatcttggcagctga

SEQ ID NO: 10052363 - DNA, 19 bp, Homo sapiens
cagagagaccaaggcgcca

SEQ ID NO: 10052364 - DNA, 22 bp, Homo sapiens
cagagagagcaggaaacctccg

SEQ ID NO: 10052365 - DNA, 18 bp, Homo sapiens
gggccctggcgtccgccc

SEQ ID NO: 10052366 - DNA, 22 bp, Homo sapiens
gggcgccgtgggaaacagccgg

SEQ ID NO: 10052367 - DNA, 22 bp, Homo sapiens
cagagcagcctccagggggagc

SEQ ID NO: 10052368 - DNA, 22 bp, Homo sapiens
cagagcagcagagcttccatgg

SEQ ID NO: 10052369 - DNA, 22 bp, Homo sapiens
gggccctggacgtggcggcaga

SEQ ID NO: 10052370 - DNA, 22 bp, Homo sapiens
cagagagcatgggaggcccgag

SEQ ID NO: 10052371 - DNA, 21 bp, Homo sapiens
cagagagctagaacttcatga

SEQ ID NO: 10052372 - DNA, 22 bp, Homo sapiens
cagagagagtggggtgtggatt

SEQ ID NO: 10052373 - DNA, 22 bp, Homo sapiens
cagagagagtctgtccctgaag

SEQ ID NO: 10052374 - DNA, 22 bp, Homo sapiens
gtctttggagaggtgccatttc

SEQ ID NO: 10052375 - DNA, 22 bp, Homo sapiens
gtctctgttatttccagggtca

SEQ ID NO: 10052376 - DNA, 22 bp, Homo sapiens
gtctctgtgtctgagagagccc

SEQ ID NO: 10052377 - DNA, 22 bp, Homo sapiens
gtctctgggttaagcagtgcat

SEQ ID NO: 10052378 - DNA, 22 bp, Homo sapiens
gtcctcttagccacttaattat

SEQ ID NO: 10052379 - DNA, 22 bp, Homo sapiens
gtcctgagatgtcacaaggttt

SEQ ID NO: 10052380 - DNA, 22 bp, Homo sapiens
gtcctgagccctcagcacagca

SEQ ID NO: 10052381 - DNA, 23 bp, Homo sapiens
cagcagagagcagacctttgtgt

SEQ ID NO: 10052382 - DNA, 22 bp, Homo sapiens
cagcagagatgagattcctata

SEQ ID NO: 10052383 - DNA, 22 bp, Homo sapiens
gtgcctgggacacagcagatac

SEQ ID NO: 10052384 - DNA, 22 bp, Homo sapiens
gtgccctgacacacctggtgtg

SEQ ID NO: 10052385 - DNA, 22 bp, Homo sapiens
gtgcatggggagggaagcgctc

SEQ ID NO: 10052386 - DNA, 22 bp, Homo sapiens
gtgctgaggagagggggtggtc

SEQ ID NO: 10052387 - DNA, 22 bp, Homo sapiens
gtgctgagattggagtgagcag

SEQ ID NO: 10052388 - DNA, 22 bp, Homo sapiens
gtgcctggtttggggagtgttc

SEQ ID NO: 10052389 - DNA, 22 bp, Homo sapiens
cagctctgaggaacactccttt

SEQ ID NO: 10052390 - DNA, 22 bp, Homo sapiens
ccccagagtgagggattgagtg

SEQ ID NO: 10052391 - DNA, 22 bp, Homo sapiens
ccccagagagcaccatgaagcc

SEQ ID NO: 10052392 - DNA, 22 bp, Homo sapiens
ccccagagaaagtcagcagcat

SEQ ID NO: 10052393 - DNA, 22 bp, Homo sapiens
ccctcaccaggctccaggcatg

SEQ ID NO: 10052394 - DNA, 22 bp, Homo sapiens
cccatctcagtcgtgctaaggg

SEQ ID NO: 10052395 - DNA, 22 bp, Homo sapiens
aggctgtctcacctcaggaggg

SEQ ID NO: 10052396 - DNA, 22 bp, Homo sapiens
aggctgtcctctcttgctcagt

SEQ ID NO: 10052397 - DNA, 22 bp, Homo sapiens
agggcctgctctatcactctca

SEQ ID NO: 10052398 - DNA, 23 bp, Homo sapiens
aggggcagcaagttttggtgtta

SEQ ID NO: 10052399 - DNA, 22 bp, Homo sapiens
aggggcacttctcaggctgtgg

SEQ ID NO: 10052400 - DNA, 22 bp, Homo sapiens
aggggcacgagtagagctctag

SEQ ID NO: 10052401 - DNA, 22 bp, Homo sapiens
aggggatggagctggaaggcag

SEQ ID NO: 10052402 - DNA, 22 bp, Homo sapiens
aggggagcaacatagtcactct

SEQ ID NO: 10052403 - DNA, 22 bp, Homo sapiens
agggtagctacccaactccaga

SEQ ID NO: 10052404 - DNA, 22 bp, Homo sapiens
ccaggtctcgggtctgctcgtg

SEQ ID NO: 10052405 - DNA, 21 bp, Homo sapiens
ccaggtcttggtccttggact

SEQ ID NO: 10052406 - DNA, 22 bp, Homo sapiens
ccaggtctgtcttcttagctca

SEQ ID NO: 10052407 - DNA, 22 bp, Homo sapiens
ccatttaacacagagttttcca

SEQ ID NO: 10052408 - DNA, 22 bp, Homo sapiens
ccatttgtcacctctgcactcc

SEQ ID NO: 10052409 - DNA, 22 bp, Homo sapiens
ccagctctgcttgcccagtcag

SEQ ID NO: 10052410 - DNA, 21 bp, Homo sapiens
ccagctctgcctccagttggt

SEQ ID NO: 10052411 - DNA, 22 bp, Homo sapiens
ccagctggcaggagagtcaggg

SEQ ID NO: 10052412 - DNA, 22 bp, Homo sapiens
ccagctcttttggctgagtgag

SEQ ID NO: 10052413 - DNA, 22 bp, Homo sapiens
ccagctggaagagtgcagaact

SEQ ID NO: 10052414 - DNA, 22 bp, Homo sapiens
ccagctggagccaaggtggact

SEQ ID NO: 10052415 - DNA, 22 bp, Homo sapiens
ccactgggggctgcaggcactc

SEQ ID NO: 10052416 - DNA, 22 bp, Homo sapiens
ccagaagacaagaatgttctta

SEQ ID NO: 10052417 - DNA, 22 bp, Homo sapiens
ccagaagaccccgtccacctcc

SEQ ID NO: 10052418 - DNA, 22 bp, Homo sapiens
ccagaccaccctggccatgcac

SEQ ID NO: 10052419 - DNA, 22 bp, Homo sapiens
ccagacagttccttgaggttca

SEQ ID NO: 10052420 - DNA, 20 bp, Homo sapiens
aggccactgaatgccaatca

SEQ ID NO: 10052421 - DNA, 22 bp, Homo sapiens
aggccagaaatgtcagggagtg

SEQ ID NO: 10052422 - DNA, 22 bp, Homo sapiens
ccagagctccagggctacagaa

SEQ ID NO: 10052423 - DNA, 22 bp, Homo sapiens
ccagagctaaacacacaggctg

SEQ ID NO: 10052424 - DNA, 22 bp, Homo sapiens
aggccaggcaacattctgaagt

SEQ ID NO: 10052425 - DNA, 22 bp, Homo sapiens
caggtcctggcatcaggcaggt

SEQ ID NO: 10052426 - DNA, 22 bp, Homo sapiens
aggaagggctgtttctccaaga

SEQ ID NO: 10052427 - DNA, 22 bp, Homo sapiens
aggaaggggagaagttaaagct

SEQ ID NO: 10052428 - DNA, 22 bp, Homo sapiens
cagggtggtgaatagctatagt

SEQ ID NO: 10052429 - DNA, 22 bp, Homo sapiens
cagggtggtaccagcatctagt

SEQ ID NO: 10052430 - DNA, 22 bp, Homo sapiens
cagggttatacagctgaacaaa

SEQ ID NO: 10052431 - DNA, 22 bp, Homo sapiens
cagggtttcaccatgttagcag

SEQ ID NO: 10052432 - DNA, 22 bp, Homo sapiens
agctttgggggaggtagtctgt

SEQ ID NO: 10052433 - DNA, 22 bp, Homo sapiens
aggaaaaataaggcagcagggc

SEQ ID NO: 10052434 - DNA, 22 bp, Homo sapiens
aggaaaaataaggcagcagggc

SEQ ID NO: 10052435 - DNA, 22 bp, Homo sapiens
aggaaaatggaccagagttgtt

SEQ ID NO: 10052436 - DNA, 22 bp, Homo sapiens
caggcagaggaagtctgggtct

SEQ ID NO: 10052437 - DNA, 22 bp, Homo sapiens
agctggtgctcaggggcatgga

SEQ ID NO: 10052438 - DNA, 22 bp, Homo sapiens
agctggagagtttccaggaagg

SEQ ID NO: 10052439 - DNA, 22 bp, Homo sapiens
agctggagaaacctgggagggt

SEQ ID NO: 10052440 - DNA, 22 bp, Homo sapiens
agctggagcttcaagcaggtaa

SEQ ID NO: 10052441 - DNA, 22 bp, Homo sapiens
agctggagccagtgtgaggctt

SEQ ID NO: 10052442 - DNA, 19 bp, Homo sapiens
agctggagattggagggca

SEQ ID NO: 10052443 - DNA, 22 bp, Homo sapiens
agctggagattctggggacagt

SEQ ID NO: 10052444 - DNA, 22 bp, Homo sapiens
agctggagattctggggacagt

SEQ ID NO: 10052445 - DNA, 22 bp, Homo sapiens
agctgggctgatgactcatgtt

SEQ ID NO: 10052446 - DNA, 23 bp, Homo sapiens
agctgggccaggtggtcagacct

SEQ ID NO: 10052447 - DNA, 22 bp, Homo sapiens
agctgcctccatggtcaaagat

SEQ ID NO: 10052448 - DNA, 22 bp, Homo sapiens
agctgcctctcttgaggttacg

SEQ ID NO: 10052449 - DNA, 22 bp, Homo sapiens
agctgctgggagaagtgagcca

SEQ ID NO: 10052450 - DNA, 22 bp, Homo sapiens
agctgctgggatacagtagtga

SEQ ID NO: 10052451 - DNA, 22 bp, Homo sapiens
agctgcctcagcaacacagacc

SEQ ID NO: 10052452 - DNA, 22 bp, Homo sapiens
aggatataaaaagactatttgg

SEQ ID NO: 10052453 - DNA, 22 bp, Homo sapiens
aggatagaagccccatgttctt

SEQ ID NO: 10052454 - DNA, 22 bp, Homo sapiens
aggataactttgaaagtaaatt

SEQ ID NO: 10052455 - DNA, 23 bp, Homo sapiens
aggataaactaaactcattttgg

SEQ ID NO: 10052456 - DNA, 22 bp, Homo sapiens
aggagtgttcagcgtggggatg

SEQ ID NO: 10052457 - DNA, 22 bp, Homo sapiens
aggcacaggtggacttcacagt

SEQ ID NO: 10052458 - DNA, 22 bp, Homo sapiens
aggcactgactcaagggagcca

SEQ ID NO: 10052459 - DNA, 23 bp, Homo sapiens
aggcactgaatgtgtcagtgagt

SEQ ID NO: 10052460 - DNA, 22 bp, Homo sapiens
aggcacaggtggacttcacagt

SEQ ID NO: 10052461 - DNA, 22 bp, Homo sapiens
aggcaggcccctgagaatagac

SEQ ID NO: 10052462 - DNA, 22 bp, Homo sapiens
ccaaacaaatccccattcttag

SEQ ID NO: 10052463 - DNA, 22 bp, Homo sapiens
ccaaacaaatccccattcttag

SEQ ID NO: 10052464 - DNA, 22 bp, Homo sapiens
aggcaggccctgggccatcccg

SEQ ID NO: 10052465 - DNA, 18 bp, Homo sapiens
aggcaggcggatcacaag

SEQ ID NO: 10052466 - DNA, 19 bp, Homo sapiens
catcagagggcataggatg

SEQ ID NO: 10052467 - DNA, 22 bp, Homo sapiens
catcagaacgtgagctccttgt

SEQ ID NO: 10052468 - DNA, 22 bp, Homo sapiens
catcagaagaaagacaaatgat

SEQ ID NO: 10052469 - DNA, 22 bp, Homo sapiens
catcagaaggaaggacgattat

SEQ ID NO: 10052470 - DNA, 22 bp, Homo sapiens
catcagaagatggctctggaaa

SEQ ID NO: 10052471 - DNA, 22 bp, Homo sapiens
catcagaatagctctgtggata

SEQ ID NO: 10052472 - DNA, 20 bp, Homo sapiens
catcagaaatcctgacccac

SEQ ID NO: 10052473 - DNA, 22 bp, Homo sapiens
cagttataggagccattgtata

SEQ ID NO: 10052474 - DNA, 22 bp, Homo sapiens
cagttcaaaattttgaagaagg

SEQ ID NO: 10052475 - DNA, 22 bp, Homo sapiens
cagttcagctagaagaaacaaa

SEQ ID NO: 10052476 - DNA, 22 bp, Homo sapiens
cagttcaggccggctgactcag

SEQ ID NO: 10052477 - DNA, 22 bp, Homo sapiens
catcattttattaaccaagaaa

SEQ ID NO: 10052478 - DNA, 22 bp, Homo sapiens
catcatttttgtaagctggtag

SEQ ID NO: 10052479 - DNA, 22 bp, Homo sapiens
aggaggctgggcacagtggcct

SEQ ID NO: 10052480 - DNA, 20 bp, Homo sapiens
cagtgcttcctcctttcttt

SEQ ID NO: 10052481 - DNA, 22 bp, Homo sapiens
aggagccaaattttagactctg

SEQ ID NO: 10052482 - DNA, 22 bp, Homo sapiens
aggagcagaccgtagtcctgca

SEQ ID NO: 10052483 - DNA, 22 bp, Homo sapiens
cttctgaggactctaaagagga

SEQ ID NO: 10052484 - DNA, 22 bp, Homo sapiens
cttctgagttaacagtagattt

SEQ ID NO: 10052485 - DNA, 22 bp, Homo sapiens
atctctctatgcactgaggact

SEQ ID NO: 10052486 - DNA, 22 bp, Homo sapiens
cttcttaaagttgtcacagctg

SEQ ID NO: 10052487 - DNA, 22 bp, Homo sapiens
cttcttaatcccttatatattt

SEQ ID NO: 10052488 - DNA, 22 bp, Homo sapiens
cttcttaactgtatatactatg

SEQ ID NO: 10052489 - DNA, 22 bp, Homo sapiens
cttcttaaattggattgctatt

SEQ ID NO: 10052490 - DNA, 22 bp, Homo sapiens
atctggttttggctgtgtccct

SEQ ID NO: 10052491 - DNA, 22 bp, Homo sapiens
atctgtaattttgaatgcaaat

SEQ ID NO: 10052492 - DNA, 22 bp, Homo sapiens
cttcaatttttggtatgatgga

SEQ ID NO: 10052493 - DNA, 22 bp, Homo sapiens
atcatacagcctttgttagtgt

SEQ ID NO: 10052494 - DNA, 22 bp, Homo sapiens
cttaaccagaaaatgcacttgt

SEQ ID NO: 10052495 - DNA, 22 bp, Homo sapiens
cttaagaagcaagtctcagcaa

SEQ ID NO: 10052496 - DNA, 22 bp, Homo sapiens
cttaagaatattgaagttgtgg

SEQ ID NO: 10052497 - DNA, 22 bp, Homo sapiens
atccatccactgatgtttctga

SEQ ID NO: 10052498 - DNA, 18 bp, Homo sapiens
ctgggtctccaggctgcc

SEQ ID NO: 10052499 - DNA, 20 bp, Homo sapiens
ctgggtggcaagcaaggggg

SEQ ID NO: 10052500 - DNA, 22 bp, Homo sapiens
ctgggtggcagagcctgcagtg

SEQ ID NO: 10052501 - DNA, 22 bp, Homo sapiens
atcaagaacttattttggaaat

SEQ ID NO: 10052502 - DNA, 22 bp, Homo sapiens
ctgggtggctgtccagccagcc

SEQ ID NO: 10052503 - DNA, 22 bp, Homo sapiens
ctgggaggacaacttggagctc

SEQ ID NO: 10052504 - DNA, 22 bp, Homo sapiens
ctgggaggcggaggttgtagtg

SEQ ID NO: 10052505 - DNA, 19 bp, Homo sapiens
ctggggctttggtactgcc

SEQ ID NO: 10052506 - DNA, 22 bp, Homo sapiens
atcataaaattgcaccatttct

SEQ ID NO: 10052507 - DNA, 22 bp, Homo sapiens
atcagtttatacttataaatct

SEQ ID NO: 10052508 - DNA, 22 bp, Homo sapiens
atcataaaccactttgtaatct

SEQ ID NO: 10052509 - DNA, 22 bp, Homo sapiens
atcatacactcacataaacaga

SEQ ID NO: 10052510 - DNA, 22 bp, Homo sapiens
atcataaagtgctatctgattg

SEQ ID NO: 10052511 - DNA, 22 bp, Homo sapiens
ctgtctccgccctcttggtagg

SEQ ID NO: 10052512 - DNA, 22 bp, Homo sapiens
ctgtctcagcaggaagtcatca

SEQ ID NO: 10052513 - DNA, 22 bp, Homo sapiens
atcagcaggtgctggtggagac

SEQ ID NO: 10052514 - DNA, 22 bp, Homo sapiens
atcaagaattgggagctattga

SEQ ID NO: 10052515 - DNA, 22 bp, Homo sapiens
atcacagacaattgtcagacca

SEQ ID NO: 10052516 - DNA, 22 bp, Homo sapiens
agttctcattgcatgagacaga

SEQ ID NO: 10052517 - DNA, 22 bp, Homo sapiens
ataaaacttgggtatgatccct

SEQ ID NO: 10052518 - DNA, 22 bp, Homo sapiens
ataaaacttattagaattgtgt

SEQ ID NO: 10052519 - DNA, 22 bp, Homo sapiens
ataaaatctttatgtgctctgc

SEQ ID NO: 10052520 - DNA, 22 bp, Homo sapiens
ataaaatcagagttggattgga

SEQ ID NO: 10052521 - DNA, 22 bp, Homo sapiens
ataaactcatgctgaaaaccca

SEQ ID NO: 10052522 - DNA, 22 bp, Homo sapiens
ataaagcaagcataccattaag

SEQ ID NO: 10052523 - DNA, 22 bp, Homo sapiens
ataaagcaaataggactattgc

SEQ ID NO: 10052524 - DNA, 22 bp, Homo sapiens
ataaagcaatagattgtgtaat

SEQ ID NO: 10052525 - DNA, 22 bp, Homo sapiens
ataaagcatactttgtatgact

SEQ ID NO: 10052526 - DNA, 22 bp, Homo sapiens
ataaagcatctagtctgtcact

SEQ ID NO: 10052527 - DNA, 22 bp, Homo sapiens
ataaagcatgcttgtttggaga

SEQ ID NO: 10052528 - DNA, 22 bp, Homo sapiens
ataaagacatgcttacttgccc

SEQ ID NO: 10052529 - DNA, 21 bp, Homo sapiens
ataaagacaaacactatttgg

SEQ ID NO: 10052530 - DNA, 22 bp, Homo sapiens
ctgcctggtctcaggcatgggg

SEQ ID NO: 10052531 - DNA, 22 bp, Homo sapiens
ctgcctgtaactttctgaagca

SEQ ID NO: 10052532 - DNA, 22 bp, Homo sapiens
ctgcctgtattgtctgcttggg

SEQ ID NO: 10052533 - DNA, 22 bp, Homo sapiens
ctgcctgtgatttttctctagt

SEQ ID NO: 10052534 - DNA, 22 bp, Homo sapiens
ctgcctgtgatttttctctagt

SEQ ID NO: 10052535 - DNA, 22 bp, Homo sapiens
ctgcctgtgccaatgctccttt

SEQ ID NO: 10052536 - DNA, 22 bp, Homo sapiens
ctgcctgtgccaccgcctcatt

SEQ ID NO: 10052537 - DNA, 22 bp, Homo sapiens
ctgcctgtgccaatgctccttt

SEQ ID NO: 10052538 - DNA, 22 bp, Homo sapiens
ctgctgggggacacaggtccgg

SEQ ID NO: 10052539 - DNA, 22 bp, Homo sapiens
ctgctgcccagtgtgcattggg

SEQ ID NO: 10052540 - DNA, 22 bp, Homo sapiens
ctgctgccattagggcacagac

SEQ ID NO: 10052541 - DNA, 19 bp, Homo sapiens
ctgctcagagcagctccag

SEQ ID NO: 10052542 - DNA, 22 bp, Homo sapiens
ctgctcagcggaaggaagagcg

SEQ ID NO: 10052543 - DNA, 22 bp, Homo sapiens
ctgctcaagtgcgcacccaggg

SEQ ID NO: 10052544 - DNA, 22 bp, Homo sapiens
ctgctagggttcagcagtgcct

SEQ ID NO: 10052545 - DNA, 22 bp, Homo sapiens
atacacaggtgctaggtcaata

SEQ ID NO: 10052546 - DNA, 22 bp, Homo sapiens
atacacatatatacacgtttaa

SEQ ID NO: 10052547 - DNA, 21 bp, Homo sapiens
atacacatacacataaatgtg

SEQ ID NO: 10052548 - DNA, 22 bp, Homo sapiens
ctgctgtgtcagagtccagggg

SEQ ID NO: 10052549 - DNA, 22 bp, Homo sapiens
ctgctgggggacacaggtccgg

SEQ ID NO: 10052550 - DNA, 22 bp, Homo sapiens
ctgctggggtcagagcactggg

SEQ ID NO: 10052551 - DNA, 20 bp, Homo sapiens
atacacattcatagaaaaat

SEQ ID NO: 10052552 - DNA, 22 bp, Homo sapiens
atacacatgtgtatgtgcatgc

SEQ ID NO: 10052553 - DNA, 22 bp, Homo sapiens
atacacatgcacacatgtgtgt

SEQ ID NO: 10052554 - DNA, 19 bp, Homo sapiens
atacatgcatttacatgct

SEQ ID NO: 10052555 - DNA, 21 bp, Homo sapiens
atagtttggagtgggaaagtc

SEQ ID NO: 10052556 - DNA, 22 bp, Homo sapiens
ctggcctttcgtgagagctggg

SEQ ID NO: 10052557 - DNA, 23 bp, Homo sapiens
atataaacaccagatagattgta

SEQ ID NO: 10052558 - DNA, 22 bp, Homo sapiens
atataaagaagtggaaaatgag

SEQ ID NO: 10052559 - DNA, 22 bp, Homo sapiens
atataaagaagtggaaaatgag

SEQ ID NO: 10052560 - DNA, 22 bp, Homo sapiens
atagtttgtgaaacacagcagt

SEQ ID NO: 10052561 - DNA, 22 bp, Homo sapiens
ctggctcttggctagggagagt

SEQ ID NO: 10052562 - DNA, 22 bp, Homo sapiens
ctgggagaggaacctcgagggt

SEQ ID NO: 10052563 - DNA, 22 bp, Homo sapiens
atatacacatgtgtatacattt

SEQ ID NO: 10052564 - DNA, 22 bp, Homo sapiens
atatacactccactgatacagg

SEQ ID NO: 10052565 - DNA, 22 bp, Homo sapiens
agttaactaaattaagagacaa

SEQ ID NO: 10052566 - DNA, 22 bp, Homo sapiens
agttccagctgtgaccagaaaa

SEQ ID NO: 10052567 - DNA, 22 bp, Homo sapiens
agttatttcagtaacataatag

SEQ ID NO: 10052568 - DNA, 22 bp, Homo sapiens
ctgagctgaaacttgagaggct

SEQ ID NO: 10052569 - DNA, 20 bp, Homo sapiens
ctgagctgagctccatgggt

SEQ ID NO: 10052570 - DNA, 22 bp, Homo sapiens
agtgtgctattgcaccatcata

SEQ ID NO: 10052571 - DNA, 22 bp, Homo sapiens
agttaacaagttggcaatcaac

SEQ ID NO: 10052572 - DNA, 22 bp, Homo sapiens
agtgtgactacattacaagagt

SEQ ID NO: 10052573 - DNA, 22 bp, Homo sapiens
agtgtattgtctcacagttctt

SEQ ID NO: 10052574 - DNA, 22 bp, Homo sapiens
agtgtattcagaatgtagcaaa

SEQ ID NO: 10052575 - DNA, 22 bp, Homo sapiens
agtgtattgattggaacagcct

SEQ ID NO: 10052576 - DNA, 22 bp, Homo sapiens
agtgtcagttgccttgtcataa

SEQ ID NO: 10052577 - DNA, 22 bp, Homo sapiens
agtgtcagctaattattcatga

SEQ ID NO: 10052578 - DNA, 22 bp, Homo sapiens
agtggtataagtctgaagatca

SEQ ID NO: 10052579 - DNA, 22 bp, Homo sapiens
agtggctaataacagctaaaca

SEQ ID NO: 10052580 - DNA, 22 bp, Homo sapiens
agtggcctggagccccgcctgg

SEQ ID NO: 10052581 - DNA, 22 bp, Homo sapiens
agtggcctggagccccgcctgg

SEQ ID NO: 10052582 - DNA, 22 bp, Homo sapiens
agtggggccgcggtcctgccct

SEQ ID NO: 10052583 - DNA, 22 bp, Homo sapiens
agtggctagatcatgagtgagc

SEQ ID NO: 10052584 - DNA, 22 bp, Homo sapiens
agtgaggtcatactggagaggg

SEQ ID NO: 10052585 - DNA, 22 bp, Homo sapiens
agtgaggtaattagagctgctg

SEQ ID NO: 10052586 - DNA, 20 bp, Homo sapiens
agtgagttatcagctacagt

SEQ ID NO: 10052587 - DNA, 22 bp, Homo sapiens
agtgagttgaacattgataatg

SEQ ID NO: 10052588 - DNA, 22 bp, Homo sapiens
agtcttctgggtgtttccagag

SEQ ID NO: 10052589 - DNA, 22 bp, Homo sapiens
agtcttctgctctgtcactaac

SEQ ID NO: 10052590 - DNA, 21 bp, Homo sapiens
agtctttgataaagacaaagt

SEQ ID NO: 10052591 - DNA, 22 bp, Homo sapiens
agtctttgaagttctgacagag

SEQ ID NO: 10052592 - DNA, 23 bp, Homo sapiens
ctcaccaagcgccgccgctgtgt

SEQ ID NO: 10052593 - DNA, 22 bp, Homo sapiens
agtggcagtggggcagggccct

SEQ ID NO: 10052594 - DNA, 22 bp, Homo sapiens
agtgccttgtgtgtgggcagcc

SEQ ID NO: 10052595 - DNA, 22 bp, Homo sapiens
agtgccttggctgtgatgggga

SEQ ID NO: 10052596 - DNA, 19 bp, Homo sapiens
agtgccttgctctctaggt

SEQ ID NO: 10052597 - DNA, 22 bp, Homo sapiens
agtgccttgggtattttgagta

SEQ ID NO: 10052598 - DNA, 22 bp, Homo sapiens
agtgatgtgggagagtatagct

SEQ ID NO: 10052599 - DNA, 22 bp, Homo sapiens
agtgatgtcacaaactatggtg

SEQ ID NO: 10052600 - DNA, 20 bp, Homo sapiens
agtaggggaatgcaagagca

SEQ ID NO: 10052601 - DNA, 20 bp, Homo sapiens
agtagcagtgtgacattgac

SEQ ID NO: 10052602 - DNA, 22 bp, Homo sapiens
agtagcagaaggtcttgaaggg

SEQ ID NO: 10052603 - DNA, 20 bp, Homo sapiens
agtagcagtaatatggaaga

SEQ ID NO: 10052604 - DNA, 22 bp, Homo sapiens
agtagcagagttggactatgca

SEQ ID NO: 10052605 - DNA, 22 bp, Homo sapiens
ccttccaggttttggctccatt

SEQ ID NO: 10052606 - DNA, 22 bp, Homo sapiens
ccttccagggctctccagaacc

SEQ ID NO: 10052607 - DNA, 22 bp, Homo sapiens
agtaaaaatatgcttgtggcta

SEQ ID NO: 10052608 - DNA, 22 bp, Homo sapiens
agtcacatcgattataaaattt

SEQ ID NO: 10052609 - DNA, 20 bp, Homo sapiens
agtcacatgcatacacaagt

SEQ ID NO: 10052610 - DNA, 22 bp, Homo sapiens
ctaggaaatgaatacagtacac

SEQ ID NO: 10052611 - DNA, 22 bp, Homo sapiens
ctatcccatccttctagctgac

SEQ ID NO: 10052612 - DNA, 22 bp, Homo sapiens
ctattgaaagtgtacaattcaa

SEQ ID NO: 10052613 - DNA, 22 bp, Homo sapiens
ctatatttcttggctttaaaca

SEQ ID NO: 10052614 - DNA, 22 bp, Homo sapiens
ctatcaaacagccattaatata

SEQ ID NO: 10052615 - DNA, 22 bp, Homo sapiens
aggtaaaatgagtctccattat

SEQ ID NO: 10052616 - DNA, 19 bp, Homo sapiens
agggttacccgctgccacc

SEQ ID NO: 10052617 - DNA, 22 bp, Homo sapiens
aggtcacagctttctcgtgagg

SEQ ID NO: 10052618 - DNA, 22 bp, Homo sapiens
aggtcaccatggcatgctccac

SEQ ID NO: 10052619 - DNA, 22 bp, Homo sapiens
aggtcaccatggcatgctccac

SEQ ID NO: 10052620 - DNA, 22 bp, Homo sapiens
aggtcaccatggcatgctccac

SEQ ID NO: 10052621 - DNA, 22 bp, Homo sapiens
aggtcagaaaaggagagcattg

SEQ ID NO: 10052622 - DNA, 22 bp, Homo sapiens
aggtcagaagtgccagggaatt

SEQ ID NO: 10052623 - DNA, 22 bp, Homo sapiens
aggtcagatgggagatgggatg

SEQ ID NO: 10052624 - DNA, 22 bp, Homo sapiens
cctggggctccagagcagcgga

SEQ ID NO: 10052625 - DNA, 22 bp, Homo sapiens
ccttccaaaggagccacatctg

SEQ ID NO: 10052626 - DNA, 22 bp, Homo sapiens
aggtggcaggaggtcagagaaa

SEQ ID NO: 10052627 - DNA, 22 bp, Homo sapiens
aggtggcagcagaatcagggag

SEQ ID NO: 10052628 - DNA, 22 bp, Homo sapiens
aggtggcagcagcctggtgaaa

SEQ ID NO: 10052629 - DNA, 22 bp, Homo sapiens
aggtggcagcagcctggtgaaa

SEQ ID NO: 10052630 - DNA, 22 bp, Homo sapiens
aggtggcagagtgacaggctga

SEQ ID NO: 10052631 - DNA, 22 bp, Homo sapiens
aggtggcagcagaatcagggag

SEQ ID NO: 10052632 - DNA, 22 bp, Homo sapiens
ccttccagatgtaagagctgat

SEQ ID NO: 10052633 - DNA, 22 bp, Homo sapiens
ccttccaagtgcttgccgcttt

SEQ ID NO: 10052634 - DNA, 22 bp, Homo sapiens
ccttccaagtgctgctttttcc

SEQ ID NO: 10052635 - DNA, 22 bp, Homo sapiens
aggtggcagagtgacaggctga

SEQ ID NO: 10052636 - DNA, 22 bp, Homo sapiens
aggtggcagactaacagaagga

SEQ ID NO: 10052637 - DNA, 22 bp, Homo sapiens
aggtggcagactaacagaagga

SEQ ID NO: 10052638 - DNA, 22 bp, Homo sapiens
aggtggcagactaacagaagga

SEQ ID NO: 10052639 - DNA, 22 bp, Homo sapiens
aggtggcagagctggcccagcg

SEQ ID NO: 10052640 - DNA, 22 bp, Homo sapiens
aggtggcagagctggcccagcg

SEQ ID NO: 10052641 - DNA, 22 bp, Homo sapiens
actacattcatgctcgtgttgg

SEQ ID NO: 10052642 - DNA, 22 bp, Homo sapiens
actagaaagcactaagctaggc

SEQ ID NO: 10052643 - DNA, 23 bp, Homo sapiens
aggtcaaccacaagctgacaaac

SEQ ID NO: 10052644 - DNA, 22 bp, Homo sapiens
agtagtgtgacaattaatattt

SEQ ID NO: 10052645 - DNA, 22 bp, Homo sapiens
aggtggggaaaccagcgatccc

SEQ ID NO: 10052646 - DNA, 22 bp, Homo sapiens
actcctgcttcttccctgagga

SEQ ID NO: 10052647 - DNA, 22 bp, Homo sapiens
actcctgctgtcactgcagttc

SEQ ID NO: 10052648 - DNA, 22 bp, Homo sapiens
actcctgccacacagatgctgt

SEQ ID NO: 10052649 - DNA, 22 bp, Homo sapiens
actgccaatggtagtttgatgg

SEQ ID NO: 10052650 - DNA, 19 bp, Homo sapiens
actgcctgaggctcacagg

SEQ ID NO: 10052651 - DNA, 23 bp, Homo sapiens
actgcctgctactatgcccacgg

SEQ ID NO: 10052652 - DNA, 22 bp, Homo sapiens
actgcctgcctctgattctgca

SEQ ID NO: 10052653 - DNA, 22 bp, Homo sapiens
actgcctgccttccaggtactg

SEQ ID NO: 10052654 - DNA, 22 bp, Homo sapiens
actgcctgctcctggctccaca

SEQ ID NO: 10052655 - DNA, 22 bp, Homo sapiens
actgcctggcctggcctcactg

SEQ ID NO: 10052656 - DNA, 22 bp, Homo sapiens
actgagctccctgagggcaggc

SEQ ID NO: 10052657 - DNA, 23 bp, Homo sapiens
actgagcattagtatttttataa

SEQ ID NO: 10052658 - DNA, 22 bp, Homo sapiens
actgagcataaatatgtgtcca

SEQ ID NO: 10052659 - DNA, 22 bp, Homo sapiens
actgagcagtagattttctgtt

SEQ ID NO: 10052660 - DNA, 22 bp, Homo sapiens
actgagcactcacttttgttat

SEQ ID NO: 10052661 - DNA, 22 bp, Homo sapiens
actgagcagaagagatctgtga

SEQ ID NO: 10052662 - DNA, 22 bp, Homo sapiens
actgagcacttggtatatttcc

SEQ ID NO: 10052663 - DNA, 22 bp, Homo sapiens
actctgccttggtgtcacaaga

SEQ ID NO: 10052664 - DNA, 22 bp, Homo sapiens
acttctaatcagaaggtctggt

SEQ ID NO: 10052665 - DNA, 22 bp, Homo sapiens
acttcctgttatgtgtgcctct

SEQ ID NO: 10052666 - DNA, 21 bp, Homo sapiens
actgggctagcctgacttctg

SEQ ID NO: 10052667 - DNA, 22 bp, Homo sapiens
actgttgtcaggctgctttgga

SEQ ID NO: 10052668 - DNA, 22 bp, Homo sapiens
ataaaaactgacccatcctttg

SEQ ID NO: 10052669 - DNA, 22 bp, Homo sapiens
atagagtgatgtaaggtatgtg

SEQ ID NO: 10052670 - DNA, 22 bp, Homo sapiens
atacatcatgctccatatattt

SEQ ID NO: 10052671 - DNA, 22 bp, Homo sapiens
actttgcaatacttaatacaaa

SEQ ID NO: 10052672 - DNA, 22 bp, Homo sapiens
actttgctgcaggtttaaagag

SEQ ID NO: 10052673 - DNA, 22 bp, Homo sapiens
actttgctcatattgagtttct

SEQ ID NO: 10052674 - DNA, 22 bp, Homo sapiens
actttgcaggtacatgagcatc

SEQ ID NO: 10052675 - DNA, 22 bp, Homo sapiens
actttgcacttcaatataactt

SEQ ID NO: 10052676 - DNA, 23 bp, Homo sapiens
actttgcagagccccttgaaaca

SEQ ID NO: 10052677 - DNA, 22 bp, Homo sapiens
actttaaaactgatcatcagag

SEQ ID NO: 10052678 - DNA, 20 bp, Homo sapiens
actttacagagaagactgac

SEQ ID NO: 10052679 - DNA, 22 bp, Homo sapiens
atacatatatggtacttcctgg

SEQ ID NO: 10052680 - DNA, 21 bp, Homo sapiens
actttacaatttacatagtga

SEQ ID NO: 10052681 - DNA, 22 bp, Homo sapiens
actttacaaactcctcactgtt

SEQ ID NO: 10052682 - DNA, 22 bp, Homo sapiens
actttacaatatcctgtgactt

SEQ ID NO: 10052683 - DNA, 21 bp, Homo sapiens
actttaatatacatgaggagg

SEQ ID NO: 10052684 - DNA, 22 bp, Homo sapiens
actttaaagcagaatggctatg

SEQ ID NO: 10052685 - DNA, 22 bp, Homo sapiens
atcccagagaataatgatcagg

SEQ ID NO: 10052686 - DNA, 21 bp, Homo sapiens
atcccagcacccaggagtgca

SEQ ID NO: 10052687 - DNA, 22 bp, Homo sapiens
agaacctctggatacagtttaa

SEQ ID NO: 10052688 - DNA, 22 bp, Homo sapiens
agaacctcaattatttttgcac

SEQ ID NO: 10052689 - DNA, 22 bp, Homo sapiens
agaaccagtttaagatttgggt

SEQ ID NO: 10052690 - DNA, 22 bp, Homo sapiens
agaacatctaaatatctgagac

SEQ ID NO: 10052691 - DNA, 22 bp, Homo sapiens
atctctgtaattacatgatatt

SEQ ID NO: 10052692 - DNA, 22 bp, Homo sapiens
atctctttgatggctcctgtga

SEQ ID NO: 10052693 - DNA, 23 bp, Homo sapiens
agaaaaacaggattgtgttccta

SEQ ID NO: 10052694 - DNA, 22 bp, Homo sapiens
acttttttataaggaagaagat

SEQ ID NO: 10052695 - DNA, 21 bp, Homo sapiens
agaaaaaccagcatgttttca

SEQ ID NO: 10052696 - DNA, 22 bp, Homo sapiens
agaaaaactaagagtgggtggt

SEQ ID NO: 10052697 - DNA, 22 bp, Homo sapiens
atcaaaaccttgacttttaatg

SEQ ID NO: 10052698 - DNA, 22 bp, Homo sapiens
atcagtatacaggggacattca

SEQ ID NO: 10052699 - DNA, 22 bp, Homo sapiens
agctttggtgctgtcacacaaa

SEQ ID NO: 10052700 - DNA, 22 bp, Homo sapiens
aggaaaaacctgttaatggtag

SEQ ID NO: 10052701 - DNA, 22 bp, Homo sapiens
aggaaaaaagtctgtgattata

SEQ ID NO: 10052702 - DNA, 22 bp, Homo sapiens
agctgtgtaggatcataacacg

SEQ ID NO: 10052703 - DNA, 19 bp, Homo sapiens
agctggctcttctttgtct

SEQ ID NO: 10052704 - DNA, 20 bp, Homo sapiens
acagccagaggaggcagaca

SEQ ID NO: 10052705 - DNA, 22 bp, Homo sapiens
agctccagtttcctgactgagc

SEQ ID NO: 10052706 - DNA, 22 bp, Homo sapiens
agctccaggtgcaagtcatggt

SEQ ID NO: 10052707 - DNA, 22 bp, Homo sapiens
acagccagaggtggtcctgggt

SEQ ID NO: 10052708 - DNA, 22 bp, Homo sapiens
acagccagtaatctacccctgt

SEQ ID NO: 10052709 - DNA, 22 bp, Homo sapiens
acagccagtcctcccacagggt

SEQ ID NO: 10052710 - DNA, 22 bp, Homo sapiens
acagccagtcctcccacagggt

SEQ ID NO: 10052711 - DNA, 22 bp, Homo sapiens
agctgcagcgttcatttttcca

SEQ ID NO: 10052712 - DNA, 23 bp, Homo sapiens
acagccagttcacctctccttgg

SEQ ID NO: 10052713 - DNA, 22 bp, Homo sapiens
acagccagtgactgcagaccct

SEQ ID NO: 10052714 - DNA, 21 bp, Homo sapiens
agctggctatagttagtgatg

SEQ ID NO: 10052715 - DNA, 22 bp, Homo sapiens
agctggctatacttgaaaagtc

SEQ ID NO: 10052716 - DNA, 22 bp, Homo sapiens
agctggctatgccctgtgaacc

SEQ ID NO: 10052717 - DNA, 22 bp, Homo sapiens
agctggctcagccgggtggtct

SEQ ID NO: 10052718 - DNA, 21 bp, Homo sapiens
agctggctctctctggagaga

SEQ ID NO: 10052719 - DNA, 22 bp, Homo sapiens
agctggcagctctcaggggtac

SEQ ID NO: 10052720 - DNA, 22 bp, Homo sapiens
acagcctgcagccccaggtcgc

SEQ ID NO: 10052721 - DNA, 22 bp, Homo sapiens
agctgctgtgtgctcaggcagg

SEQ ID NO: 10052722 - DNA, 22 bp, Homo sapiens
agctgctgtggggctcggcctg

SEQ ID NO: 10052723 - DNA, 22 bp, Homo sapiens
agctgctgtttcttgcacgtat

SEQ ID NO: 10052724 - DNA, 22 bp, Homo sapiens
agctgctgtttggtgagtcttg

SEQ ID NO: 10052725 - DNA, 22 bp, Homo sapiens
agctgcttgtacatgaccacat

SEQ ID NO: 10052726 - DNA, 23 bp, Homo sapiens
acagccccatgcaggtgtgtttg

SEQ ID NO: 10052727 - DNA, 23 bp, Homo sapiens
acagccccatgcaggtgtgtttg

SEQ ID NO: 10052728 - DNA, 22 bp, Homo sapiens
acagccccccgctcagtttcca

SEQ ID NO: 10052729 - DNA, 22 bp, Homo sapiens
acagccccagcgcggcggggtc

SEQ ID NO: 10052730 - DNA, 22 bp, Homo sapiens
acagcccaggactccagtgggc

SEQ ID NO: 10052731 - DNA, 22 bp, Homo sapiens
acagggtgactttgtgacagat

SEQ ID NO: 10052732 - DNA, 23 bp, Homo sapiens
aggagccatgagttggatatgtt

SEQ ID NO: 10052733 - DNA, 22 bp, Homo sapiens
aggagcccctcttcagtcctgg

SEQ ID NO: 10052734 - DNA, 22 bp, Homo sapiens
aggaggggcatagaaatgtaat

SEQ ID NO: 10052735 - DNA, 22 bp, Homo sapiens
aggaggccgatttcagaggtcg

SEQ ID NO: 10052736 - DNA, 22 bp, Homo sapiens
aggaggggttctcgggtgctga

SEQ ID NO: 10052737 - DNA, 22 bp, Homo sapiens
aggaggggttctcgggtgctga

SEQ ID NO: 10052738 - DNA, 22 bp, Homo sapiens
aggcacagagaatgccctccat

SEQ ID NO: 10052739 - DNA, 22 bp, Homo sapiens
aggcacagagaggttaaatgca

SEQ ID NO: 10052740 - DNA, 22 bp, Homo sapiens
acatacaaatagagctgtagta

SEQ ID NO: 10052741 - DNA, 22 bp, Homo sapiens
acatacatcaagtatcacaaga

SEQ ID NO: 10052742 - DNA, 22 bp, Homo sapiens
acattcaaggcagcactgagtg

SEQ ID NO: 10052743 - DNA, 22 bp, Homo sapiens
acattctagatatgttatattt

SEQ ID NO: 10052744 - DNA, 22 bp, Homo sapiens
acattccaaaaactagcagata

SEQ ID NO: 10052745 - DNA, 22 bp, Homo sapiens
aggcttcagaaagagtaattgg

SEQ ID NO: 10052746 - DNA, 22 bp, Homo sapiens
aggctccaggcaaaatttcgga

SEQ ID NO: 10052747 - DNA, 22 bp, Homo sapiens
aggctccaggcccttcaccagc

SEQ ID NO: 10052748 - DNA, 22 bp, Homo sapiens
aggctccaggcaatgtttctga

SEQ ID NO: 10052749 - DNA, 22 bp, Homo sapiens
aggctccagggctgtgtgggag

SEQ ID NO: 10052750 - DNA, 22 bp, Homo sapiens
aggctccaggcctccctgcatg

SEQ ID NO: 10052751 - DNA, 22 bp, Homo sapiens
acattgaacagtacaaatgatc

SEQ ID NO: 10052752 - DNA, 23 bp, Homo sapiens
aggctccactccctgggatgtgg

SEQ ID NO: 10052753 - DNA, 22 bp, Homo sapiens
aggctccagcagccagaggaag

SEQ ID NO: 10052754 - DNA, 22 bp, Homo sapiens
aggctccagcccaaggctgcag

SEQ ID NO: 10052755 - DNA, 22 bp, Homo sapiens
aggctccagccaatgggtctgt

SEQ ID NO: 10052756 - DNA, 22 bp, Homo sapiens
aggcccagcttgaagtgggaag

SEQ ID NO: 10052757 - DNA, 22 bp, Homo sapiens
acatgaaactgttgcattagaa

SEQ ID NO: 10052758 - DNA, 22 bp, Homo sapiens
acatgaaaactggttccttcag

SEQ ID NO: 10052759 - DNA, 22 bp, Homo sapiens
acatctttgctcttatagagct

SEQ ID NO: 10052760 - DNA, 22 bp, Homo sapiens
aggccagccctcacctgtgttc

SEQ ID NO: 10052761 - DNA, 22 bp, Homo sapiens
acatacatgggattaaaaaatt

SEQ ID NO: 10052762 - DNA, 22 bp, Homo sapiens
acatacatggtgctttcttggt

SEQ ID NO: 10052763 - DNA, 22 bp, Homo sapiens
acatacatgggattaaaaaatt

SEQ ID NO: 10052764 - DNA, 22 bp, Homo sapiens
acccagagcactgggtgtgggc

SEQ ID NO: 10052765 - DNA, 17 bp, Homo sapiens
acccagagaaggaggtc

SEQ ID NO: 10052766 - DNA, 22 bp, Homo sapiens
acccagagactagcacggtaca

SEQ ID NO: 10052767 - DNA, 22 bp, Homo sapiens
acccagagaactgaggcatgaa

SEQ ID NO: 10052768 - DNA, 22 bp, Homo sapiens
acccaccctactagcagtgtcc

SEQ ID NO: 10052769 - DNA, 22 bp, Homo sapiens
accaaagggcagaacatgagca

SEQ ID NO: 10052770 - DNA, 22 bp, Homo sapiens
accaaaggcagagctgaacact

SEQ ID NO: 10052771 - DNA, 23 bp, Homo sapiens
accaacaagcctctggagagtgg

SEQ ID NO: 10052772 - DNA, 23 bp, Homo sapiens
accaacaagcctctggagagtgg

SEQ ID NO: 10052773 - DNA, 22 bp, Homo sapiens
accaacatgtcctcacacagcc

SEQ ID NO: 10052774 - DNA, 22 bp, Homo sapiens
accaatctcctattttgtttca

SEQ ID NO: 10052775 - DNA, 22 bp, Homo sapiens
accaattttagagcaccaagaa

SEQ ID NO: 10052776 - DNA, 20 bp, Homo sapiens
accaatttcagaggtgcaga

SEQ ID NO: 10052777 - DNA, 22 bp, Homo sapiens
accaatttcttggcttccaaat

SEQ ID NO: 10052778 - DNA, 22 bp, Homo sapiens
accaatttttacagctgtggtt

SEQ ID NO: 10052779 - DNA, 22 bp, Homo sapiens
accacagctttgcaccaggtgt

SEQ ID NO: 10052780 - DNA, 22 bp, Homo sapiens
accaggactttgtattcagctt

SEQ ID NO: 10052781 - DNA, 22 bp, Homo sapiens
accaggacattttagtcatctt

SEQ ID NO: 10052782 - DNA, 22 bp, Homo sapiens
accaggacttcattaggttctt

SEQ ID NO: 10052783 - DNA, 22 bp, Homo sapiens
accaggaatattttgctcattt

SEQ ID NO: 10052784 - DNA, 22 bp, Homo sapiens
accaggaggaagtgttaatgat

SEQ ID NO: 10052785 - DNA, 22 bp, Homo sapiens
accaggagccatagagtcaggc

SEQ ID NO: 10052786 - DNA, 20 bp, Homo sapiens
accaggagatggaggcaggg

SEQ ID NO: 10052787 - DNA, 20 bp, Homo sapiens
accaggagatggaggcaggg

SEQ ID NO: 10052788 - DNA, 22 bp, Homo sapiens
accaggagccacaggaggagcc

SEQ ID NO: 10052789 - DNA, 22 bp, Homo sapiens
accagggttgagtcagctgcgt

SEQ ID NO: 10052790 - DNA, 22 bp, Homo sapiens
accaggtggccccagcgtggtt

SEQ ID NO: 10052791 - DNA, 19 bp, Homo sapiens
accaggagtatcagagctg

SEQ ID NO: 10052792 - DNA, 22 bp, Homo sapiens
accaggagtctagcctagtcaa

SEQ ID NO: 10052793 - DNA, 22 bp, Homo sapiens
accaggagtaacagtgagtggt

SEQ ID NO: 10052794 - DNA, 22 bp, Homo sapiens
accaggagggaccctggtggcc

SEQ ID NO: 10052795 - DNA, 22 bp, Homo sapiens
accagggttgagtcagctgcgt

SEQ ID NO: 10052796 - DNA, 22 bp, Homo sapiens
accagggccgcgggcgactagc

SEQ ID NO: 10052797 - DNA, 22 bp, Homo sapiens
agatcacagcccccagatgcca

SEQ ID NO: 10052798 - DNA, 22 bp, Homo sapiens
attggtatgtattctgaaaact

SEQ ID NO: 10052799 - DNA, 21 bp, Homo sapiens
agatgctgtgctccaggagca

SEQ ID NO: 10052800 - DNA, 22 bp, Homo sapiens
agatcagagtggattgtgctgc

SEQ ID NO: 10052801 - DNA, 22 bp, Homo sapiens
agatcatatgaaaaatttcaag

SEQ ID NO: 10052802 - DNA, 22 bp, Homo sapiens
agatcatatgcagtaatgaact

SEQ ID NO: 10052803 - DNA, 22 bp, Homo sapiens
agatgggccttcgagcatgccc

SEQ ID NO: 10052804 - DNA, 22 bp, Homo sapiens
caaaggcaggtcatggccactt

SEQ ID NO: 10052805 - DNA, 22 bp, Homo sapiens
caaagcaagggctgaagactcc

SEQ ID NO: 10052806 - DNA, 22 bp, Homo sapiens
agcaagaagggcaaggaagttt

SEQ ID NO: 10052807 - DNA, 22 bp, Homo sapiens
attttcagaacattcattcact

SEQ ID NO: 10052808 - DNA, 22 bp, Homo sapiens
agaggtgacataggagaggctc

SEQ ID NO: 10052809 - DNA, 23 bp, Homo sapiens
agagtccacaagattttccagtg

SEQ ID NO: 10052810 - DNA, 22 bp, Homo sapiens
agagtcagactaagccatggtg

SEQ ID NO: 10052811 - DNA, 22 bp, Homo sapiens
agagtccatgaagacagctgag

SEQ ID NO: 10052812 - DNA, 22 bp, Homo sapiens
agagtccatatgtgggaggagt

SEQ ID NO: 10052813 - DNA, 22 bp, Homo sapiens
agagtccagaaaacagtgtgct

SEQ ID NO: 10052814 - DNA, 22 bp, Homo sapiens
agagtctgaatgctcagagttg

SEQ ID NO: 10052815 - DNA, 22 bp, Homo sapiens
agaggctgggtacgggccacct

SEQ ID NO: 10052816 - DNA, 22 bp, Homo sapiens
agaggggaggcgaaccagagtc

SEQ ID NO: 10052817 - DNA, 23 bp, Homo sapiens
agaggggagcatctgctggctga

SEQ ID NO: 10052818 - DNA, 22 bp, Homo sapiens
agaggggcaagtaaagagtctt

SEQ ID NO: 10052819 - DNA, 22 bp, Homo sapiens
agaggggctcaagcagtggtct

SEQ ID NO: 10052820 - DNA, 22 bp, Homo sapiens
agaggtgacataggagaggctc

SEQ ID NO: 10052821 - DNA, 22 bp, Homo sapiens
agaggggctcaagcagtggtct

SEQ ID NO: 10052822 - DNA, 22 bp, Homo sapiens
agaggggcccggttctccgtct

SEQ ID NO: 10052823 - DNA, 22 bp, Homo sapiens
agaggggcgggaactcaacctc

SEQ ID NO: 10052824 - DNA, 18 bp, Homo sapiens
agaggctggacaggggat

SEQ ID NO: 10052825 - DNA, 22 bp, Homo sapiens
attacacaggctggctctttga

SEQ ID NO: 10052826 - DNA, 22 bp, Homo sapiens
attacacatagacattcgttca

SEQ ID NO: 10052827 - DNA, 22 bp, Homo sapiens
agaggcacggaggctgcatgga

SEQ ID NO: 10052828 - DNA, 22 bp, Homo sapiens
attacagaagatatgctcaaca

SEQ ID NO: 10052829 - DNA, 22 bp, Homo sapiens
attacagaaatatggtcaaaga

SEQ ID NO: 10052830 - DNA, 23 bp, Homo sapiens
agacactgtaaagaattgcagtt

SEQ ID NO: 10052831 - DNA, 22 bp, Homo sapiens
agacactgtgtacagaaaaaga

SEQ ID NO: 10052832 - DNA, 22 bp, Homo sapiens
agacaaggctggagtttaggca

SEQ ID NO: 10052833 - DNA, 22 bp, Homo sapiens
agacactttcagaagtgtttgc

SEQ ID NO: 10052834 - DNA, 22 bp, Homo sapiens
agacaacatcactaaagctgag

SEQ ID NO: 10052835 - DNA, 22 bp, Homo sapiens
agacaacaccaaatgctagtgt

SEQ ID NO: 10052836 - DNA, 22 bp, Homo sapiens
agacaaggcaaggcggccagat

SEQ ID NO: 10052837 - DNA, 22 bp, Homo sapiens
agaatcaaagagaaatactttg

SEQ ID NO: 10052838 - DNA, 22 bp, Homo sapiens
agaatcaattagattctatgag

SEQ ID NO: 10052839 - DNA, 20 bp, Homo sapiens
atctgctgagaatgaaaggc

SEQ ID NO: 10052840 - DNA, 22 bp, Homo sapiens
atctgctgcccagccacttgct

SEQ ID NO: 10052841 - DNA, 17 bp, Homo sapiens
atctgctgacattctgt

SEQ ID NO: 10052842 - DNA, 18 bp, Homo sapiens
atctgctggcaggtctgg

SEQ ID NO: 10052843 - DNA, 22 bp, Homo sapiens
atctgctgtcacatgtttgaag

SEQ ID NO: 10052844 - DNA, 22 bp, Homo sapiens
atctgctggcatctctagccca

SEQ ID NO: 10052845 - DNA, 22 bp, Homo sapiens
atctgctgtgtgtaatggaatg

SEQ ID NO: 10052846 - DNA, 22 bp, Homo sapiens
atctgctgttcttcacagcttg

SEQ ID NO: 10052847 - DNA, 22 bp, Homo sapiens
atctgcttagaattcattgtcc

SEQ ID NO: 10052848 - DNA, 22 bp, Homo sapiens
atgcatttgtaaaatataatcg

SEQ ID NO: 10052849 - DNA, 22 bp, Homo sapiens
atgatacatttacctatggtct

SEQ ID NO: 10052850 - DNA, 22 bp, Homo sapiens
agacagaatttgtcagataaat

SEQ ID NO: 10052851 - DNA, 22 bp, Homo sapiens
agactggggttctggcaaggag

SEQ ID NO: 10052852 - DNA, 22 bp, Homo sapiens
agactttaacaatgggtatgaa

SEQ ID NO: 10052853 - DNA, 22 bp, Homo sapiens
agactttagaatcagatagcct

SEQ ID NO: 10052854 - DNA, 22 bp, Homo sapiens
agactttaatgtgcaaatgaaa

SEQ ID NO: 10052855 - DNA, 22 bp, Homo sapiens
agactttatagtttttggctat

SEQ ID NO: 10052856 - DNA, 22 bp, Homo sapiens
agactttatccctgtttttctc

SEQ ID NO: 10052857 - DNA, 22 bp, Homo sapiens
agactttataaatcttaatttc

SEQ ID NO: 10052858 - DNA, 22 bp, Homo sapiens
agactttagggccatggtaggt

SEQ ID NO: 10052859 - DNA, 22 bp, Homo sapiens
agactttagatacgtcttcttc

SEQ ID NO: 10052860 - DNA, 22 bp, Homo sapiens
agactgtgagaagatggctgcg

SEQ ID NO: 10052861 - DNA, 22 bp, Homo sapiens
agagaggctgggcgtagggctt

SEQ ID NO: 10052862 - DNA, 22 bp, Homo sapiens
agagagcctgagtggcagctat

SEQ ID NO: 10052863 - DNA, 22 bp, Homo sapiens
agagagcccgggccagggcaca

SEQ ID NO: 10052864 - DNA, 22 bp, Homo sapiens
agagagcccgggccagggcaca

SEQ ID NO: 10052865 - DNA, 22 bp, Homo sapiens
agagaattggagcagtgacagg

SEQ ID NO: 10052866 - DNA, 22 bp, Homo sapiens
agagacaaacactgcaacttct

SEQ ID NO: 10052867 - DNA, 19 bp, Homo sapiens
agagacacaggtaagtagg

SEQ ID NO: 10052868 - DNA, 21 bp, Homo sapiens
agagacagagaaagtaacatt

SEQ ID NO: 10052869 - DNA, 22 bp, Homo sapiens
agagacacatcatataagtata

SEQ ID NO: 10052870 - DNA, 22 bp, Homo sapiens
agagacaccgcgcatcatggct

SEQ ID NO: 10052871 - DNA, 22 bp, Homo sapiens
agagagcccgggccagggcaca

SEQ ID NO: 10052872 - DNA, 22 bp, Homo sapiens
agagcactgctgatttacagtc

SEQ ID NO: 10052873 - DNA, 22 bp, Homo sapiens
agagcacagtatctgcacatca

SEQ ID NO: 10052874 - DNA, 22 bp, Homo sapiens
agagcagatggccagggggcct

SEQ ID NO: 10052875 - DNA, 22 bp, Homo sapiens
agagccaggccaggccggggca

SEQ ID NO: 10052876 - DNA, 22 bp, Homo sapiens
agagccaggcaggcaatgttga

SEQ ID NO: 10052877 - DNA, 22 bp, Homo sapiens
agagcctgaggatgtcccagct

SEQ ID NO: 10052878 - DNA, 21 bp, Homo sapiens
agagcctgagatcttccagca

SEQ ID NO: 10052879 - DNA, 23 bp, Homo sapiens
agagcctgaaagacttctggcac

SEQ ID NO: 10052880 - DNA, 21 bp, Homo sapiens
agagctggcctgccaggccct

SEQ ID NO: 10052881 - DNA, 22 bp, Homo sapiens
agagctggctggtagccctgat

SEQ ID NO: 10052882 - DNA, 22 bp, Homo sapiens
agagctgaaaaagctgacccgg

SEQ ID NO: 10052883 - DNA, 22 bp, Homo sapiens
agccctgcttcaccatttactt

SEQ ID NO: 10052884 - DNA, 22 bp, Homo sapiens
agccccagttccctggaagtct

SEQ ID NO: 10052885 - DNA, 22 bp, Homo sapiens
cagagctctatgttcatggagg

SEQ ID NO: 10052886 - DNA, 22 bp, Homo sapiens
cagagctctctttgctactaca

SEQ ID NO: 10052887 - DNA, 22 bp, Homo sapiens
agccccacactctctctgagaa

SEQ ID NO: 10052888 - DNA, 22 bp, Homo sapiens
agccccagcccctctctcacaa

SEQ ID NO: 10052889 - DNA, 22 bp, Homo sapiens
agccccaggatgggccgcagga

SEQ ID NO: 10052890 - DNA, 22 bp, Homo sapiens
agccagcagggcttagaggaca

SEQ ID NO: 10052891 - DNA, 17 bp, Homo sapiens
agccagcagtagctggt

SEQ ID NO: 10052892 - DNA, 22 bp, Homo sapiens
agccagcatatatatagttgaa

SEQ ID NO: 10052893 - DNA, 22 bp, Homo sapiens
agccagcaggaacgtctaggtt

SEQ ID NO: 10052894 - DNA, 19 bp, Homo sapiens
agccagcagcgtagcatct

SEQ ID NO: 10052895 - DNA, 22 bp, Homo sapiens
agccagcatcccttcagtctcc

SEQ ID NO: 10052896 - DNA, 22 bp, Homo sapiens
agccagcacggatttcccagga

SEQ ID NO: 10052897 - DNA, 22 bp, Homo sapiens
agccagagttgaatgtgagtct

SEQ ID NO: 10052898 - DNA, 22 bp, Homo sapiens
cagagacccttctcagtggcca

SEQ ID NO: 10052899 - DNA, 20 bp, Homo sapiens
cagagaccaggccaggtgtc

SEQ ID NO: 10052900 - DNA, 22 bp, Homo sapiens
cagagaccctaggcaggtgaca

SEQ ID NO: 10052901 - DNA, 22 bp, Homo sapiens
cagagaacaaagctgagggttt

SEQ ID NO: 10052902 - DNA, 22 bp, Homo sapiens
cagagacatccattttatatgc

SEQ ID NO: 10052903 - DNA, 22 bp, Homo sapiens
cagagacattcagtaaattatc

SEQ ID NO: 10052904 - DNA, 22 bp, Homo sapiens
cagagacatgtggcctgcacgt

SEQ ID NO: 10052905 - DNA, 22 bp, Homo sapiens
cagagcggccactagagggcgc

SEQ ID NO: 10052906 - DNA, 22 bp, Homo sapiens
cagagcctttgtgtccacattt

SEQ ID NO: 10052907 - DNA, 22 bp, Homo sapiens
cagagctcagagctgccaggca

SEQ ID NO: 10052908 - DNA, 22 bp, Homo sapiens
cagagctcagagctgccaggca

SEQ ID NO: 10052909 - DNA, 22 bp, Homo sapiens
agccaggccagactcacaccct

SEQ ID NO: 10052910 - DNA, 22 bp, Homo sapiens
agccaggccttagggagaggca

SEQ ID NO: 10052911 - DNA, 23 bp, Homo sapiens
agctccagaacatagcacaggaa

SEQ ID NO: 10052912 - DNA, 22 bp, Homo sapiens
agctccagaagcctgcaaggta

SEQ ID NO: 10052913 - DNA, 22 bp, Homo sapiens
agctcctgtctcaagggagcct

SEQ ID NO: 10052914 - DNA, 22 bp, Homo sapiens
agctcttccacctcatgatggg

SEQ ID NO: 10052915 - DNA, 22 bp, Homo sapiens
agctcctggcaaggtcatggtg

SEQ ID NO: 10052916 - DNA, 22 bp, Homo sapiens
agctagagctgagaagcacttg

SEQ ID NO: 10052917 - DNA, 22 bp, Homo sapiens
agctacacccctttacagtcct

SEQ ID NO: 10052918 - DNA, 22 bp, Homo sapiens
agcggcagcagatgtgatcagg

SEQ ID NO: 10052919 - DNA, 21 bp, Homo sapiens
agcggcagaccctgcatttga

SEQ ID NO: 10052920 - DNA, 21 bp, Homo sapiens
agcctgggaggcggaggttgc

SEQ ID NO: 10052921 - DNA, 22 bp, Homo sapiens
agcagggcagtgatcagaaagg

SEQ ID NO: 10052922 - DNA, 22 bp, Homo sapiens
agcagggcagctgatgcgcacg

SEQ ID NO: 10052923 - DNA, 20 bp, Homo sapiens
caccagcagcagctgccacc

SEQ ID NO: 10052924 - DNA, 22 bp, Homo sapiens
cacagcagaaagtgtaggagga

SEQ ID NO: 10052925 - DNA, 22 bp, Homo sapiens
cacagcagacagggaggcggct

SEQ ID NO: 10052926 - DNA, 22 bp, Homo sapiens
agcatgctatattgattgtagt

SEQ ID NO: 10052927 - DNA, 22 bp, Homo sapiens
agcatggcattattggaaggac

SEQ ID NO: 10052928 - DNA, 18 bp, Homo sapiens
agcatggcacaggctccc

SEQ ID NO: 10052929 - DNA, 22 bp, Homo sapiens
agcatggcactcaaggctcctg

SEQ ID NO: 10052930 - DNA, 22 bp, Homo sapiens
agcatggctttggaggatagca

SEQ ID NO: 10052931 - DNA, 19 bp, Homo sapiens
agcatggcctacagtgtgc

SEQ ID NO: 10052932 - DNA, 22 bp, Homo sapiens
agcatggctttggaggatagca

SEQ ID NO: 10052933 - DNA, 21 bp, Homo sapiens
agcatgtctcagtcaacaagg

SEQ ID NO: 10052934 - DNA, 23 bp, Homo sapiens
cactgtgttacatgttgaagatg

SEQ ID NO: 10052935 - DNA, 22 bp, Homo sapiens
agcatcagcagactctcagcta

SEQ ID NO: 10052936 - DNA, 22 bp, Homo sapiens
agcatcagagagaagttaacta

SEQ ID NO: 10052937 - DNA, 22 bp, Homo sapiens
agcagaggacagttcttaggaa

SEQ ID NO: 10052938 - DNA, 22 bp, Homo sapiens
agcagagctgggatcctgggtc

SEQ ID NO: 10052939 - DNA, 22 bp, Homo sapiens
agcagagctgcagtggcctgct

SEQ ID NO: 10052940 - DNA, 22 bp, Homo sapiens
agcagagctattcttgtgcaat

SEQ ID NO: 10052941 - DNA, 22 bp, Homo sapiens
agcagagcggggcctccggaag

SEQ ID NO: 10052942 - DNA, 22 bp, Homo sapiens
agcagagcgcctgctcagaggg

SEQ ID NO: 10052943 - DNA, 20 bp, Homo sapiens
caataatttacttccctatt

SEQ ID NO: 10052944 - DNA, 22 bp, Homo sapiens
caataatttacattggatacca

SEQ ID NO: 10052945 - DNA, 22 bp, Homo sapiens
caataatatcctgtgctgtttg

SEQ ID NO: 10052946 - DNA, 22 bp, Homo sapiens
caataattgctttccagagtta

SEQ ID NO: 10052947 - DNA, 21 bp, Homo sapiens
agcagaggggacatgtttgat

SEQ ID NO: 10052948 - DNA, 23 bp, Homo sapiens
agcactcatgctgcagaagtcat

SEQ ID NO: 10052949 - DNA, 22 bp, Homo sapiens
caaaggctgccactgtggctgt

SEQ ID NO: 10052950 - DNA, 22 bp, Homo sapiens
caaaggcttcatctcagagcag

SEQ ID NO: 10052951 - DNA, 22 bp, Homo sapiens
caaaggcttccactgcatcctt

SEQ ID NO: 10052952 - DNA, 22 bp, Homo sapiens
caaaggctttgctatgatgcat

SEQ ID NO: 10052953 - DNA, 21 bp, Homo sapiens
cacagagatattggtgagcct

SEQ ID NO: 10052954 - DNA, 22 bp, Homo sapiens
cacagagatcggaacagaagta

SEQ ID NO: 10052955 - DNA, 21 bp, Homo sapiens
cacagagatattggtgagcct

SEQ ID NO: 10052956 - DNA, 22 bp, Homo sapiens
cacagagatggccagggcacat

SEQ ID NO: 10052957 - DNA, 22 bp, Homo sapiens
cacagagatcggaacagaagta

SEQ ID NO: 10052958 - DNA, 21 bp, Homo sapiens
cacagagatattggtgagcct

SEQ ID NO: 10052959 - DNA, 22 bp, Homo sapiens
cacagagaggcttgtctccaag

SEQ ID NO: 10052960 - DNA, 19 bp, Homo sapiens
agcagctcagggaggcacc

SEQ ID NO: 10052961 - DNA, 21 bp, Homo sapiens
agcagccttgtgtgccaggca

SEQ ID NO: 10052962 - DNA, 22 bp, Homo sapiens
cacagagatggtctggcaggtg

SEQ ID NO: 10052963 - DNA, 22 bp, Homo sapiens
cacagagattagaattagacta

SEQ ID NO: 10052964 - DNA, 22 bp, Homo sapiens
cacagagatggtctggcaggtg

SEQ ID NO: 10052965 - DNA, 22 bp, Homo sapiens
cacagagatggccagggcacat

SEQ ID NO: 10052966 - DNA, 22 bp, Homo sapiens
agcagctggaacatatgaagaa

SEQ ID NO: 10052967 - DNA, 21 bp, Homo sapiens
agcagctgggcaacatggagg

SEQ ID NO: 10052968 - DNA, 22 bp, Homo sapiens
agcagccttgcaggggtcgcac

SEQ ID NO: 10052969 - DNA, 22 bp, Homo sapiens
agcagcctctgtagaggtctcc

SEQ ID NO: 10052970 - DNA, 22 bp, Homo sapiens
agcagcctgcagatattggtct

SEQ ID NO: 10052971 - DNA, 22 bp, Homo sapiens
agcagcctcccagggagcagcc

SEQ ID NO: 10052972 - DNA, 22 bp, Homo sapiens
agcagcctcccagggagcagcc

SEQ ID NO: 10052973 - DNA, 22 bp, Homo sapiens
agcagcctattcttctcttgga

SEQ ID NO: 10052974 - DNA, 22 bp, Homo sapiens
agcagccagaaatccagaggtg

SEQ ID NO: 10052975 - DNA, 16 bp, Homo sapiens
caatacatggcatttc

SEQ ID NO: 10052976 - DNA, 22 bp, Homo sapiens
caatacatcaggtcaaaatgtg

SEQ ID NO: 10052977 - DNA, 22 bp, Homo sapiens
caatacaattaccagttaatca

SEQ ID NO: 10052978 - DNA, 22 bp, Homo sapiens
aatatggctccattcctttagg

SEQ ID NO: 10052979 - DNA, 22 bp, Homo sapiens
agaaaactggagcctggggttg

SEQ ID NO: 10052980 - DNA, 22 bp, Homo sapiens
agaaaataatttcttggctggt

SEQ ID NO: 10052981 - DNA, 22 bp, Homo sapiens
aatcttggttgcagtatatccg

SEQ ID NO: 10052982 - DNA, 22 bp, Homo sapiens
aatctttaaggactcagtctct

SEQ ID NO: 10052983 - DNA, 22 bp, Homo sapiens
aatcttttaggggatcctgagg

SEQ ID NO: 10052984 - DNA, 22 bp, Homo sapiens
aatcttttgattctagggctgt

SEQ ID NO: 10052985 - DNA, 22 bp, Homo sapiens
aatctttttcacaagaaagcac

SEQ ID NO: 10052986 - DNA, 20 bp, Homo sapiens
actgttggaagtggagaatg

SEQ ID NO: 10052987 - DNA, 22 bp, Homo sapiens
acttcccactgcagtgactgag

SEQ ID NO: 10052988 - DNA, 22 bp, Homo sapiens
aatatgaattattgttacaagt

SEQ ID NO: 10052989 - DNA, 22 bp, Homo sapiens
aataacagattttcaagctgtg

SEQ ID NO: 10052990 - DNA, 22 bp, Homo sapiens
aataacagtgccatgaaattga

SEQ ID NO: 10052991 - DNA, 22 bp, Homo sapiens
aataaccttacttattacatgg

SEQ ID NO: 10052992 - DNA, 22 bp, Homo sapiens
actgtggcaaagaagcaggctc

SEQ ID NO: 10052993 - DNA, 22 bp, Homo sapiens
aagtgaattcattgtgttatat

SEQ ID NO: 10052994 - DNA, 22 bp, Homo sapiens
aagtgaatagcctatttactag

SEQ ID NO: 10052995 - DNA, 22 bp, Homo sapiens
aagtgaatctcctttctttatt

SEQ ID NO: 10052996 - DNA, 22 bp, Homo sapiens
aagtgatttgtacaaaatgtcg

SEQ ID NO: 10052997 - DNA, 22 bp, Homo sapiens
aataacagagaagggtggcttc

SEQ ID NO: 10052998 - DNA, 22 bp, Homo sapiens
actgagaagctcgcagtgatgc

SEQ ID NO: 10052999 - DNA, 22 bp, Homo sapiens
actgagaagctcgcagtgatgc

SEQ ID NO: 10053000 - DNA, 22 bp, Homo sapiens
actgacactgactaagacagca

SEQ ID NO: 10053001 - DNA, 22 bp, Homo sapiens
aagtggctaacagtccttgcct

SEQ ID NO: 10053002 - DNA, 22 bp, Homo sapiens
acattctctccatgtcttcttt

SEQ ID NO: 10053003 - DNA, 22 bp, Homo sapiens
acattatagttgctacagagta

SEQ ID NO: 10053004 - DNA, 22 bp, Homo sapiens
acattacagcaagtttacgtta

SEQ ID NO: 10053005 - DNA, 22 bp, Homo sapiens
acattacataagattgtaacct

SEQ ID NO: 10053006 - DNA, 22 bp, Homo sapiens
acatggtatttctattataatt

SEQ ID NO: 10053007 - DNA, 22 bp, Homo sapiens
acatgtaaaagataaattaaca

SEQ ID NO: 10053008 - DNA, 22 bp, Homo sapiens
acataacatagttgacattttt

SEQ ID NO: 10053009 - DNA, 22 bp, Homo sapiens
acataacactcttctctagtga

SEQ ID NO: 10053010 - DNA, 22 bp, Homo sapiens
acatagaaatttatttcttaca

SEQ ID NO: 10053011 - DNA, 22 bp, Homo sapiens
acatgccaagatcctcgtcttt

SEQ ID NO: 10053012 - DNA, 22 bp, Homo sapiens
acatggtatgtattttaagaga

SEQ ID NO: 10053013 - DNA, 22 bp, Homo sapiens
acatggtaaattggtaaaggac

SEQ ID NO: 10053014 - DNA, 22 bp, Homo sapiens
acatggggcccaaagagaggtc

SEQ ID NO: 10053015 - DNA, 22 bp, Homo sapiens
acatggggcccaaagagaggtc

SEQ ID NO: 10053016 - DNA, 22 bp, Homo sapiens
acatgggatcaatgaggcaggc

SEQ ID NO: 10053017 - DNA, 23 bp, Homo sapiens
acatgggagggacatggaggctg

SEQ ID NO: 10053018 - DNA, 22 bp, Homo sapiens
acattctgtttccccaaagaga

SEQ ID NO: 10053019 - DNA, 22 bp, Homo sapiens
accacccacctcacagcatagt

SEQ ID NO: 10053020 - DNA, 17 bp, Homo sapiens
accacctctcaccagca

SEQ ID NO: 10053021 - DNA, 22 bp, Homo sapiens
accaggcactcctgaggtctga

SEQ ID NO: 10053022 - DNA, 22 bp, Homo sapiens
accaggcagagctgggccttaa

SEQ ID NO: 10053023 - DNA, 22 bp, Homo sapiens
accaggcagctgggggtgatgt

SEQ ID NO: 10053024 - DNA, 22 bp, Homo sapiens
accaggcagcaccaaagccggt

SEQ ID NO: 10053025 - DNA, 22 bp, Homo sapiens
accaggagttttgaccaggggc

SEQ ID NO: 10053026 - DNA, 22 bp, Homo sapiens
aagtaaaacacacagtccaccg

SEQ ID NO: 10053027 - DNA, 22 bp, Homo sapiens
aagtaaaagcaggtgtgctggg

SEQ ID NO: 10053028 - DNA, 22 bp, Homo sapiens
aagtaaaagctttaccatgcgc

SEQ ID NO: 10053029 - DNA, 22 bp, Homo sapiens
aagtaaaattcaatcttcactg

SEQ ID NO: 10053030 - DNA, 22 bp, Homo sapiens
accaggccaaaatcatatttac

SEQ ID NO: 10053031 - DNA, 21 bp, Homo sapiens
accaggccaggaggctggcac

SEQ ID NO: 10053032 - DNA, 22 bp, Homo sapiens
aaggttagtgcatcttttgttt

SEQ ID NO: 10053033 - DNA, 22 bp, Homo sapiens
aaggttagtaatatttctatat

SEQ ID NO: 10053034 - DNA, 22 bp, Homo sapiens
acagatgaggaaacagggtcag

SEQ ID NO: 10053035 - DNA, 23 bp, Homo sapiens
acagcttgccaattagccttccg

SEQ ID NO: 10053036 - DNA, 22 bp, Homo sapiens
acagcttttgaaaaattactgg

SEQ ID NO: 10053037 - DNA, 22 bp, Homo sapiens
acaggaacccagaaacatttct

SEQ ID NO: 10053038 - DNA, 22 bp, Homo sapiens
acaggcactgtcaagtcatgaa

SEQ ID NO: 10053039 - DNA, 22 bp, Homo sapiens
acaggcactgtcaagtcatgaa

SEQ ID NO: 10053040 - DNA, 22 bp, Homo sapiens
acaggtctccagagtgagagga

SEQ ID NO: 10053041 - DNA, 22 bp, Homo sapiens
acaggctctggggcaggatggc

SEQ ID NO: 10053042 - DNA, 20 bp, Homo sapiens
acagtgggtggggagcactg

SEQ ID NO: 10053043 - DNA, 22 bp, Homo sapiens
acagtgctaatgatgccaagat

SEQ ID NO: 10053044 - DNA, 22 bp, Homo sapiens
acagtgctgaacgacatggaag

SEQ ID NO: 10053045 - DNA, 22 bp, Homo sapiens
acagtgctgatctagactgacc

SEQ ID NO: 10053046 - DNA, 22 bp, Homo sapiens
acagtgtagcatggtagcaatg

SEQ ID NO: 10053047 - DNA, 19 bp, Homo sapiens
acagtgcatgggacctggt

SEQ ID NO: 10053048 - DNA, 22 bp, Homo sapiens
acagtctttctacattctgtgc

SEQ ID NO: 10053049 - DNA, 22 bp, Homo sapiens
acaggtgtagcaggagcatcaa

SEQ ID NO: 10053050 - DNA, 22 bp, Homo sapiens
agacactggcactggggaagcc

SEQ ID NO: 10053051 - DNA, 22 bp, Homo sapiens
agacactggtgaagaaatcagg

SEQ ID NO: 10053052 - DNA, 22 bp, Homo sapiens
agacactgaaatgtattgaaga

SEQ ID NO: 10053053 - DNA, 22 bp, Homo sapiens
agacactgaaatgtattgaaga

SEQ ID NO: 10053054 - DNA, 22 bp, Homo sapiens
agacactgaatgtttggtggtc

SEQ ID NO: 10053055 - DNA, 22 bp, Homo sapiens
agacactgagcattttcctagc

SEQ ID NO: 10053056 - DNA, 22 bp, Homo sapiens
agacactgatgttcagctcaat

SEQ ID NO: 10053057 - DNA, 22 bp, Homo sapiens
agacactgccacttctgttccc

SEQ ID NO: 10053058 - DNA, 19 bp, Homo sapiens
agacactggatggaaaatg

SEQ ID NO: 10053059 - DNA, 22 bp, Homo sapiens
agactgggccatttccccagct

SEQ ID NO: 10053060 - DNA, 22 bp, Homo sapiens
agactggcttgctttacaagga

SEQ ID NO: 10053061 - DNA, 23 bp, Homo sapiens
agactgaggctgccagggtcaga

SEQ ID NO: 10053062 - DNA, 22 bp, Homo sapiens
agactgatattaactttagtgt

SEQ ID NO: 10053063 - DNA, 22 bp, Homo sapiens
agagacagggttttgccatgtt

SEQ ID NO: 10053064 - DNA, 17 bp, Homo sapiens
agagagagcatgccacc

SEQ ID NO: 10053065 - DNA, 22 bp, Homo sapiens
aatgtaaaatatcttgtacttg

SEQ ID NO: 10053066 - DNA, 23 bp, Homo sapiens
agacaaaagcctcagtcttaggc

SEQ ID NO: 10053067 - DNA, 23 bp, Homo sapiens
agaattgtaaatagaatatacct

SEQ ID NO: 10053068 - DNA, 22 bp, Homo sapiens
agaattgtaataataatagcat

SEQ ID NO: 10053069 - DNA, 22 bp, Homo sapiens
agaataaatgttggacttagga

SEQ ID NO: 10053070 - DNA, 22 bp, Homo sapiens
agaatcagtgagcagttgtgat

SEQ ID NO: 10053071 - DNA, 22 bp, Homo sapiens
agaagtttgttatgtaaacaaa

SEQ ID NO: 10053072 - DNA, 22 bp, Homo sapiens
agaataaatgctacctatcaca

SEQ ID NO: 10053073 - DNA, 22 bp, Homo sapiens
aatggaatacctaggtggccca

SEQ ID NO: 10053074 - DNA, 19 bp, Homo sapiens
aatggacaggcaatagtct

SEQ ID NO: 10053075 - DNA, 22 bp, Homo sapiens
aatgctttgactatatctataa

SEQ ID NO: 10053076 - DNA, 22 bp, Homo sapiens
aatgaaaattggaccctagaac

SEQ ID NO: 10053077 - DNA, 22 bp, Homo sapiens
aattcagagactcattctggag

SEQ ID NO: 10053078 - DNA, 22 bp, Homo sapiens
aattcagatggaagattctggc

SEQ ID NO: 10053079 - DNA, 22 bp, Homo sapiens
aattcacaggaggtatttgtcc

SEQ ID NO: 10053080 - DNA, 19 bp, Homo sapiens
agaggcagtctccaacagg

SEQ ID NO: 10053081 - DNA, 22 bp, Homo sapiens
aatttcaaagctcactggcata

SEQ ID NO: 10053082 - DNA, 22 bp, Homo sapiens
aatttcaaactaataggaacca

SEQ ID NO: 10053083 - DNA, 22 bp, Homo sapiens
agagggctaactgggaagcagg

SEQ ID NO: 10053084 - DNA, 22 bp, Homo sapiens
agagggctaactgggaagcagg

SEQ ID NO: 10053085 - DNA, 22 bp, Homo sapiens
agagggcattaactctgtcttg

SEQ ID NO: 10053086 - DNA, 22 bp, Homo sapiens
agagggcatgcttggtggcctg

SEQ ID NO: 10053087 - DNA, 22 bp, Homo sapiens
agagggctgcctcagtcagcta

SEQ ID NO: 10053088 - DNA, 22 bp, Homo sapiens
acaaaaagctccattactgtcc

SEQ ID NO: 10053089 - DNA, 22 bp, Homo sapiens
acaaaaaccgtggattcagcat

SEQ ID NO: 10053090 - DNA, 22 bp, Homo sapiens
agaggtgtggccaggactcaag

SEQ ID NO: 10053091 - DNA, 22 bp, Homo sapiens
agaggtgtcttgcttattgtta

SEQ ID NO: 10053092 - DNA, 21 bp, Homo sapiens
agagtaattcctgctggaaag

SEQ ID NO: 10053093 - DNA, 22 bp, Homo sapiens
agagtcttttgtcagtaatgtt

SEQ ID NO: 10053094 - DNA, 22 bp, Homo sapiens
agagtcttgttaacttgctaag

SEQ ID NO: 10053095 - DNA, 22 bp, Homo sapiens
agagtcttatcttttacaagta

SEQ ID NO: 10053096 - DNA, 22 bp, Homo sapiens
agagtcttagcctcattagtca

SEQ ID NO: 10053097 - DNA, 22 bp, Homo sapiens
agagtctgtgctttcatcagga

SEQ ID NO: 10053098 - DNA, 22 bp, Homo sapiens
acacactgagtgccataggacc

SEQ ID NO: 10053099 - DNA, 22 bp, Homo sapiens
agcactttattcaggaactcca

SEQ ID NO: 10053100 - DNA, 22 bp, Homo sapiens
agcactttaagcaacagatcaa

SEQ ID NO: 10053101 - DNA, 22 bp, Homo sapiens
agatttccgttctctcttcagt

SEQ ID NO: 10053102 - DNA, 22 bp, Homo sapiens
acacacatgcctttcctaagta

SEQ ID NO: 10053103 - DNA, 22 bp, Homo sapiens
agcagcatacacatcatgttga

SEQ ID NO: 10053104 - DNA, 22 bp, Homo sapiens
agcagccagagtctgaacatta

SEQ ID NO: 10053105 - DNA, 22 bp, Homo sapiens
agcagcaactgctagagtggca

SEQ ID NO: 10053106 - DNA, 21 bp, Homo sapiens
agcagcaaccacatagttttt

SEQ ID NO: 10053107 - DNA, 19 bp, Homo sapiens
agcagcagctaccacttgt

SEQ ID NO: 10053108 - DNA, 19 bp, Homo sapiens
agcagccatcgaccatgga

SEQ ID NO: 10053109 - DNA, 22 bp, Homo sapiens
agcagccatttaaaatgaattg

SEQ ID NO: 10053110 - DNA, 22 bp, Homo sapiens
agcagccagtgggagtgataca

SEQ ID NO: 10053111 - DNA, 22 bp, Homo sapiens
agcagctctgagaggccagcac

SEQ ID NO: 10053112 - DNA, 22 bp, Homo sapiens
agcaggagcccttatcaccagg

SEQ ID NO: 10053113 - DNA, 22 bp, Homo sapiens
agcatcagcctctgtcctggag

SEQ ID NO: 10053114 - DNA, 22 bp, Homo sapiens
agcatcagtactaatctggcca

SEQ ID NO: 10053115 - DNA, 22 bp, Homo sapiens
agcagggctttggctggctttc

SEQ ID NO: 10053116 - DNA, 23 bp, Homo sapiens
agcaggcatctgtggcacaaggc

SEQ ID NO: 10053117 - DNA, 23 bp, Homo sapiens
agcaggcatctgtggcacaaggc

SEQ ID NO: 10053118 - DNA, 19 bp, Homo sapiens
agcaggcaggtggcccagg

SEQ ID NO: 10053119 - DNA, 22 bp, Homo sapiens
agcaggcatagagtagcactca

SEQ ID NO: 10053120 - DNA, 22 bp, Homo sapiens
agcattctcagaatgtcatttt

SEQ ID NO: 10053121 - DNA, 22 bp, Homo sapiens
agcattcattgctagaatgtaa

SEQ ID NO: 10053122 - DNA, 22 bp, Homo sapiens
agcatctggcctggttactttt

SEQ ID NO: 10053123 - DNA, 22 bp, Homo sapiens
agcatttaagcttctgcaaagc

SEQ ID NO: 10053124 - DNA, 22 bp, Homo sapiens
acagaacatattgcttctctca

SEQ ID NO: 10053125 - DNA, 22 bp, Homo sapiens
acagaacaggctgagaaaaaca

SEQ ID NO: 10053126 - DNA, 22 bp, Homo sapiens
agcccaggtgaggggttcgaaa

SEQ ID NO: 10053127 - DNA, 22 bp, Homo sapiens
acagacagtaaatagtgtggct

SEQ ID NO: 10053128 - DNA, 22 bp, Homo sapiens
agcctggccaggcctgcccagg

SEQ ID NO: 10053129 - DNA, 22 bp, Homo sapiens
agcctgctggaccaagctcatg

SEQ ID NO: 10053130 - DNA, 22 bp, Homo sapiens
agcctgcttccctttgtgcccc

SEQ ID NO: 10053131 - DNA, 22 bp, Homo sapiens
agcctgctgggaagggaggctt

SEQ ID NO: 10053132 - DNA, 22 bp, Homo sapiens
agccctgccctgccatgtggca

SEQ ID NO: 10053133 - DNA, 22 bp, Homo sapiens
agcctgttctggtactccaggt

SEQ ID NO: 10053134 - DNA, 22 bp, Homo sapiens
agcctgtgtgctttggacaggg

SEQ ID NO: 10053135 - DNA, 22 bp, Homo sapiens
agcctgttcagtccactctcca

SEQ ID NO: 10053136 - DNA, 22 bp, Homo sapiens
aacaatgttcttttagcttgaa

SEQ ID NO: 10053137 - DNA, 22 bp, Homo sapiens
aacaagaacacctacagttcta

SEQ ID NO: 10053138 - DNA, 22 bp, Homo sapiens
aacaagaacacctacagttcta

SEQ ID NO: 10053139 - DNA, 22 bp, Homo sapiens
aacaagaagagagggacgtaat

SEQ ID NO: 10053140 - DNA, 22 bp, Homo sapiens
aacaagaagggaaggcatgatt

SEQ ID NO: 10053141 - DNA, 22 bp, Homo sapiens
aacaagaataagtggtttctgg

SEQ ID NO: 10053142 - DNA, 22 bp, Homo sapiens
aacacaaaaattctcaggggca

SEQ ID NO: 10053143 - DNA, 23 bp, Homo sapiens
aacacaaagctgattccagtggc

SEQ ID NO: 10053144 - DNA, 22 bp, Homo sapiens
aacacataggcagagcatgaca

SEQ ID NO: 10053145 - DNA, 22 bp, Homo sapiens
aacacaaagaagctgcaggatc

SEQ ID NO: 10053146 - DNA, 22 bp, Homo sapiens
aacaaattagttgcaagactgg

SEQ ID NO: 10053147 - DNA, 22 bp, Homo sapiens
aacaaatgtgttttgtaattaa

SEQ ID NO: 10053148 - DNA, 22 bp, Homo sapiens
aacaacaacggagaaagggttg

SEQ ID NO: 10053149 - DNA, 22 bp, Homo sapiens
aacaacaacggagaaagggttg

SEQ ID NO: 10053150 - DNA, 22 bp, Homo sapiens
aaagcacatgagtagtgtagta

SEQ ID NO: 10053151 - DNA, 22 bp, Homo sapiens
aaagcacaggagagttcagtaa

SEQ ID NO: 10053152 - DNA, 22 bp, Homo sapiens
aaatggtaggttttcttaagaa

SEQ ID NO: 10053153 - DNA, 22 bp, Homo sapiens
aaatggtgaagtgtaatttagc

SEQ ID NO: 10053154 - DNA, 21 bp, Homo sapiens
aactgagaccagctaaagtgg

SEQ ID NO: 10053155 - DNA, 22 bp, Homo sapiens
aactgagacacgaactatgatt

SEQ ID NO: 10053156 - DNA, 20 bp, Homo sapiens
aactgagagttcaggaggag

SEQ ID NO: 10053157 - DNA, 22 bp, Homo sapiens
aactgagattacaagagacatt

SEQ ID NO: 10053158 - DNA, 20 bp, Homo sapiens
aactatgaatagaagagatt

SEQ ID NO: 10053159 - DNA, 22 bp, Homo sapiens
aactatactctgtaaatgtgct

SEQ ID NO: 10053160 - DNA, 20 bp, Homo sapiens
aacagtaccatttatctcag

SEQ ID NO: 10053161 - DNA, 22 bp, Homo sapiens
aacaggaaaacagcacaatagc

SEQ ID NO: 10053162 - DNA, 22 bp, Homo sapiens
aagacactgatactctgtgatt

SEQ ID NO: 10053163 - DNA, 22 bp, Homo sapiens
aagacactgatactctgtgatt

SEQ ID NO: 10053164 - DNA, 22 bp, Homo sapiens
aagacactttctaaatagaagt

SEQ ID NO: 10053165 - DNA, 22 bp, Homo sapiens
aagaatgttcaacgcttttttg

SEQ ID NO: 10053166 - DNA, 22 bp, Homo sapiens
aagacagaccacgtgacagggc

SEQ ID NO: 10053167 - DNA, 17 bp, Homo sapiens
aagacagaagccatgag

SEQ ID NO: 10053168 - DNA, 22 bp, Homo sapiens
aagacagagactctgcaacagg

SEQ ID NO: 10053169 - DNA, 23 bp, Homo sapiens
aagaatgcttctgaagagctgcc

SEQ ID NO: 10053170 - DNA, 22 bp, Homo sapiens
aagaatgattacaaagcaacga

SEQ ID NO: 10053171 - DNA, 22 bp, Homo sapiens
aagaatgagctcaaagatctta

SEQ ID NO: 10053172 - DNA, 22 bp, Homo sapiens
aagaatgattacaaagcaacga

SEQ ID NO: 10053173 - DNA, 22 bp, Homo sapiens
aacttttcattccaaaggtgct

SEQ ID NO: 10053174 - DNA, 22 bp, Homo sapiens
aaatatcatttataacttttaa

SEQ ID NO: 10053175 - DNA, 22 bp, Homo sapiens
aagcaaaggcaggagcttgtga

SEQ ID NO: 10053176 - DNA, 22 bp, Homo sapiens
aagcaaagtgaattttgccaag

SEQ ID NO: 10053177 - DNA, 22 bp, Homo sapiens
aagcaaaggcaggagcttgtga

SEQ ID NO: 10053178 - DNA, 22 bp, Homo sapiens
aagcaaagagataaccttttgg

SEQ ID NO: 10053179 - DNA, 22 bp, Homo sapiens
aagcagcaacaaactggataaa

SEQ ID NO: 10053180 - DNA, 22 bp, Homo sapiens
aagcactggagatgccagagtg

SEQ ID NO: 10053181 - DNA, 22 bp, Homo sapiens
aagcagcagacctgattttgaa

SEQ ID NO: 10053182 - DNA, 22 bp, Homo sapiens
aagcagcacagtaatattggtg

SEQ ID NO: 10053183 - DNA, 22 bp, Homo sapiens
aaatcagttcacgttctgaggt

SEQ ID NO: 10053184 - DNA, 22 bp, Homo sapiens
aaatgctgagtgtttagagatc

SEQ ID NO: 10053185 - DNA, 22 bp, Homo sapiens
aaatggcagtagaaaagaatcc

SEQ ID NO: 10053186 - DNA, 22 bp, Homo sapiens
aaatgcctgtgtaaattctagc

SEQ ID NO: 10053187 - DNA, 22 bp, Homo sapiens
aaatgcctgtgtaaattctagc

SEQ ID NO: 10053188 - DNA, 23 bp, Homo sapiens
aaatgccagggagacaggaacca

SEQ ID NO: 10053189 - DNA, 22 bp, Homo sapiens
aaatgcctcattttctctcact

SEQ ID NO: 10053190 - DNA, 22 bp, Homo sapiens
aaatactgttgaatgaagtaag

SEQ ID NO: 10053191 - DNA, 22 bp, Homo sapiens
aaacatcataggcatgcatgat

SEQ ID NO: 10053192 - DNA, 22 bp, Homo sapiens
aaacactggtatgatgtatagt

SEQ ID NO: 10053193 - DNA, 22 bp, Homo sapiens
aaacactggcaatttcatgcac

SEQ ID NO: 10053194 - DNA, 22 bp, Homo sapiens
aaagtcattttccagaccagta

SEQ ID NO: 10053195 - DNA, 22 bp, Homo sapiens
aaagtcatttgtatataccctt

SEQ ID NO: 10053196 - DNA, 22 bp, Homo sapiens
aaaggccttttccccacttctt

SEQ ID NO: 10053197 - DNA, 22 bp, Homo sapiens
aaagcaatggatgagaatctgt

SEQ ID NO: 10053198 - DNA, 22 bp, Homo sapiens
aaaggcattttaattctaaaga

SEQ ID NO: 10053199 - DNA, 22 bp, Homo sapiens
aaagatgtcagtttgaaataac

SEQ ID NO: 10053200 - DNA, 23 bp, Homo sapiens
aaagatgtgagtattcatatggc

SEQ ID NO: 10053201 - DNA, 22 bp, Homo sapiens
aaagcaatgcttgtggaatgta

SEQ ID NO: 10053202 - DNA, 22 bp, Homo sapiens
aaacatgagttaaaagtaactg

SEQ ID NO: 10053203 - DNA, 22 bp, Homo sapiens
aaacatgagcatctcttcaagc

SEQ ID NO: 10053204 - DNA, 22 bp, Homo sapiens
aaacatgagttaaaagtaactg

SEQ ID NO: 10053205 - DNA, 22 bp, Homo sapiens
aaagaacttatcctagaatttg

SEQ ID NO: 10053206 - DNA, 22 bp, Homo sapiens
aaagaactacctgtatgatatt

SEQ ID NO: 10053207 - DNA, 20 bp, Homo sapiens
aaacttgatggcatagaata

SEQ ID NO: 10053208 - DNA, 22 bp, Homo sapiens
aaagaagatggagacctgacta

SEQ ID NO: 10053209 - DNA, 22 bp, Homo sapiens
aaacacacagaaatgaatgagg

SEQ ID NO: 10053210 - DNA, 22 bp, Homo sapiens
aaacacaatgtttctttgttct

SEQ ID NO: 10053211 - DNA, 22 bp, Homo sapiens
aaacacacctttggaactgtga

SEQ ID NO: 10053212 - DNA, 22 bp, Homo sapiens
aaacaacatggtgggtgtgtag

SEQ ID NO: 10053213 - DNA, 22 bp, Homo sapiens
aaacaaatagtgcatgggaatt

SEQ ID NO: 10053214 - DNA, 22 bp, Homo sapiens
aaacaaagcatcttgctatgca

SEQ ID NO: 10053215 - DNA, 22 bp, Homo sapiens
aaacaaacataggtttgaaagt

SEQ ID NO: 10053216 - DNA, 22 bp, Homo sapiens
aaacaaacaattagttgtgtgg

SEQ ID NO: 10053217 - DNA, 22 bp, Homo sapiens
aaaaagactagtcgagtgcagt

SEQ ID NO: 10053218 - DNA, 22 bp, Homo sapiens
aaaaagacttccaactcaggag

SEQ ID NO: 10053219 - DNA, 22 bp, Homo sapiens
aaaaactgtaattacttttgca

SEQ ID NO: 10053220 - DNA, 19 bp, Homo sapiens
aaaaacttagtccagaaag

SEQ ID NO: 10053221 - DNA, 20 bp, Homo sapiens
aaaaagacaaaacgagttgg

SEQ ID NO: 10053222 - DNA, 22 bp, Homo sapiens
aaaagtctacaagcttcaacaa

SEQ ID NO: 10053223 - DNA, 22 bp, Homo sapiens
aaaaatgcttggacttaataaa

SEQ ID NO: 10053224 - DNA, 18 bp, Homo sapiens
aacagtttccagattctc

SEQ ID NO: 10053225 - DNA, 22 bp, Homo sapiens
aataaaatggtcagttttctca

SEQ ID NO: 10053226 - DNA, 20 bp, Homo sapiens
aagttacattgtattgtacc

SEQ ID NO: 10053227 - DNA, 22 bp, Homo sapiens
aagttgagatgtcataggagac

SEQ ID NO: 10053228 - DNA, 22 bp, Homo sapiens
aagttgagatgtcataggagac

SEQ ID NO: 10053229 - DNA, 22 bp, Homo sapiens
aactatacatatttacatagac

SEQ ID NO: 10053230 - DNA, 22 bp, Homo sapiens
aatcacattagtgaaacactga

SEQ ID NO: 10053231 - DNA, 22 bp, Homo sapiens
aatcacatttacattgctaatt

SEQ ID NO: 10053232 - DNA, 22 bp, Homo sapiens
aatcagaaaattcagtggaatt

SEQ ID NO: 10053233 - DNA, 22 bp, Homo sapiens
aacattaagatggcggaacagt

SEQ ID NO: 10053234 - DNA, 22 bp, Homo sapiens
aacattgcattctctatgagat

SEQ ID NO: 10053235 - DNA, 22 bp, Homo sapiens
aacattgctgaaagctgggaca

SEQ ID NO: 10053236 - DNA, 22 bp, Homo sapiens
aatatttgaacagtcactgagt

SEQ ID NO: 10053237 - DNA, 22 bp, Homo sapiens
aaggggaagtagcaccagaggt

SEQ ID NO: 10053238 - DNA, 22 bp, Homo sapiens
aaggggaatagagtgggttgtg

SEQ ID NO: 10053239 - DNA, 22 bp, Homo sapiens
aaggggcacaattgtacccaag

SEQ ID NO: 10053240 - DNA, 22 bp, Homo sapiens
aaggggctcttgtcaggcgcag

SEQ ID NO: 10053241 - DNA, 22 bp, Homo sapiens
aacaataggacctttatgttct

SEQ ID NO: 10053242 - DNA, 22 bp, Homo sapiens
aacaatgccaacagcatgctgg

SEQ ID NO: 10053243 - DNA, 22 bp, Homo sapiens
aacaatgcactatcgtaagtgg

SEQ ID NO: 10053244 - DNA, 22 bp, Homo sapiens
aacaatgctgaactgaggaaag

SEQ ID NO: 10053245 - DNA, 19 bp, Homo sapiens
aacaagtaggaatggaaga

SEQ ID NO: 10053246 - DNA, 22 bp, Homo sapiens
aaggactaatgaatagatgaat

SEQ ID NO: 10053247 - DNA, 22 bp, Homo sapiens
aaattattataggcagagctga

SEQ ID NO: 10053248 - DNA, 22 bp, Homo sapiens
aaattattatgcccctctataa

SEQ ID NO: 10053249 - DNA, 22 bp, Homo sapiens
aaggacaggttggggcttcagg

SEQ ID NO: 10053250 - DNA, 22 bp, Homo sapiens
aagctttgcaatgcttcattat

SEQ ID NO: 10053251 - DNA, 22 bp, Homo sapiens
aagctttgactactgcctcttg

SEQ ID NO: 10053252 - DNA, 22 bp, Homo sapiens
aagctttcagagcagaatgtga

SEQ ID NO: 10053253 - DNA, 22 bp, Homo sapiens
aagccagcattttcccattcct

SEQ ID NO: 10053254 - DNA, 22 bp, Homo sapiens
aagctgcaaaaaatttctgtct

SEQ ID NO: 10053255 - DNA, 22 bp, Homo sapiens
aagccatttgttgtccttcagg

SEQ ID NO: 10053256 - DNA, 22 bp, Homo sapiens
aagctggcatgtcacctgagaa

SEQ ID NO: 10053257 - DNA, 22 bp, Homo sapiens
aattagaagggagttattgata

SEQ ID NO: 10053258 - DNA, 22 bp, Homo sapiens
aattcaaagactagaattttgc

SEQ ID NO: 10053259 - DNA, 22 bp, Homo sapiens
aagacaagcatcaaatcaggca

SEQ ID NO: 10053260 - DNA, 17 bp, Homo sapiens
aagacaagacaaatgca

SEQ ID NO: 10053261 - DNA, 22 bp, Homo sapiens
aagacaaaggggtccttggatg

SEQ ID NO: 10053262 - DNA, 22 bp, Homo sapiens
aagaatcttaatccagaaacct

SEQ ID NO: 10053263 - DNA, 22 bp, Homo sapiens
aattcacaaaaccagattgctt

SEQ ID NO: 10053264 - DNA, 22 bp, Homo sapiens
acaactgtcagtaaagaatatt

SEQ ID NO: 10053265 - DNA, 22 bp, Homo sapiens
acaacaaaatgaggaagtggtc

SEQ ID NO: 10053266 - DNA, 22 bp, Homo sapiens
aagacacacacatatgctgagt

SEQ ID NO: 10053267 - DNA, 22 bp, Homo sapiens
aagacacaatgtagcccagcac

SEQ ID NO: 10053268 - DNA, 22 bp, Homo sapiens
aagacacaaagcttcccttttc

SEQ ID NO: 10053269 - DNA, 22 bp, Homo sapiens
aagacaatttgatactagttgc

SEQ ID NO: 10053270 - DNA, 22 bp, Homo sapiens
acaagaaccaaagaaggatatt

SEQ ID NO: 10053271 - DNA, 22 bp, Homo sapiens
acaagaaccaaagaaggatatt

SEQ ID NO: 10053272 - DNA, 22 bp, Homo sapiens
acaagaaaggtaggattcaggt

SEQ ID NO: 10053273 - DNA, 22 bp, Homo sapiens
acaagaatgtagattagttaag

SEQ ID NO: 10053274 - DNA, 22 bp, Homo sapiens
aactccttaatgcatttcagag

SEQ ID NO: 10053275 - DNA, 22 bp, Homo sapiens
aactctttggtctcaggaaagg

SEQ ID NO: 10053276 - DNA, 22 bp, Homo sapiens
aatgtcaatctcagagaacaca

SEQ ID NO: 10053277 - DNA, 22 bp, Homo sapiens
aatgtcttgagaagagaaatct

SEQ ID NO: 10053278 - DNA, 22 bp, Homo sapiens
aatgtctttctcataacagata

SEQ ID NO: 10053279 - DNA, 22 bp, Homo sapiens
aatgtctttaaagtgcaataga

SEQ ID NO: 10053280 - DNA, 22 bp, Homo sapiens
aatgtatttgatgtattagcct

SEQ ID NO: 10053281 - DNA, 22 bp, Homo sapiens
aatgtcaaaatggaatgagact

SEQ ID NO: 10053282 - DNA, 22 bp, Homo sapiens
aatgtgaaaccgcacagaataa

SEQ ID NO: 10053283 - DNA, 22 bp, Homo sapiens
aatgtcttttgatacaagttac

SEQ ID NO: 10053284 - DNA, 22 bp, Homo sapiens
aactttcagaatcctatgcatt

SEQ ID NO: 10053285 - DNA, 22 bp, Homo sapiens
aagagtcatagagacattgatt

SEQ ID NO: 10053286 - DNA, 22 bp, Homo sapiens
aagagttatgaaagcaaggcat

SEQ ID NO: 10053287 - DNA, 23 bp, Homo sapiens
acacctgtgctgtagtcactaca

SEQ ID NO: 10053288 - DNA, 22 bp, Homo sapiens
aagagtttaccagtgctgcttc

SEQ ID NO: 10053289 - DNA, 22 bp, Homo sapiens
acactacaatctcagaactata

SEQ ID NO: 10053290 - DNA, 22 bp, Homo sapiens
acactacaacagcagaggtgag

SEQ ID NO: 10053291 - DNA, 22 bp, Homo sapiens
acactacagggagaagactcac

SEQ ID NO: 10053292 - DNA, 22 bp, Homo sapiens
acacacaggtaaaggagcctgg

SEQ ID NO: 10053293 - DNA, 22 bp, Homo sapiens
acacacagaaggaagccccact

SEQ ID NO: 10053294 - DNA, 20 bp, Homo sapiens
acacacagagacatgcgcat

SEQ ID NO: 10053295 - DNA, 22 bp, Homo sapiens
acacacagcgcctaccatgtgc

SEQ ID NO: 10053296 - DNA, 22 bp, Homo sapiens
acacacagagtttatacaggca

SEQ ID NO: 10053297 - DNA, 22 bp, Homo sapiens
aagacatttatttgaatcaatt

SEQ ID NO: 10053298 - DNA, 22 bp, Homo sapiens
acagatcctggttacagccatt

SEQ ID NO: 10053299 - DNA, 22 bp, Homo sapiens
aagcacatttggaaaacatgga

SEQ ID NO: 10053300 - DNA, 22 bp, Homo sapiens
acagagctgtactacttactga

SEQ ID NO: 10053301 - DNA, 22 bp, Homo sapiens
acagagcttaggatgactccca

SEQ ID NO: 10053302 - DNA, 22 bp, Homo sapiens
acagaagcaaagactcaggcaa

SEQ ID NO: 10053303 - DNA, 22 bp, Homo sapiens
aagcaaaaggttacacttctgg

SEQ ID NO: 10053304 - DNA, 22 bp, Homo sapiens
aagcaaaacgtgctctaggagg

SEQ ID NO: 10053305 - DNA, 21 bp, Homo sapiens
ggcactgctgggccatctgct

SEQ ID NO: 10053306 - DNA, 22 bp, Homo sapiens
ggcactgcccaccctcacaggg

SEQ ID NO: 10053307 - DNA, 22 bp, Homo sapiens
ggcactgtgtacacacagagac

SEQ ID NO: 10053308 - DNA, 22 bp, Homo sapiens
ggcactgtttttgtattcagtt

SEQ ID NO: 10053309 - DNA, 22 bp, Homo sapiens
ggcactttgattttgagatgca

SEQ ID NO: 10053310 - DNA, 22 bp, Homo sapiens
ggcactttccagtctatagagc

SEQ ID NO: 10053311 - DNA, 18 bp, Homo sapiens
ggcactggtgatgcagag

SEQ ID NO: 10053312 - DNA, 22 bp, Homo sapiens
ggcagaaggcaattagagactg

SEQ ID NO: 10053313 - DNA, 22 bp, Homo sapiens
ggcagcaggagccatctggtag

SEQ ID NO: 10053314 - DNA, 22 bp, Homo sapiens
ggcagccatgcacgctgcctgg

SEQ ID NO: 10053315 - DNA, 22 bp, Homo sapiens
ggcagccagagggcagctggat

SEQ ID NO: 10053316 - DNA, 22 bp, Homo sapiens
ggagatgtagtgtcactggact

SEQ ID NO: 10053317 - DNA, 22 bp, Homo sapiens
ggagcagagctgggcttggctg

SEQ ID NO: 10053318 - DNA, 22 bp, Homo sapiens
ggagcagagctcttcatctgca

SEQ ID NO: 10053319 - DNA, 22 bp, Homo sapiens
ggagcagagcatttcacagcct

SEQ ID NO: 10053320 - DNA, 22 bp, Homo sapiens
ggattcagtgtctgttaatagt

SEQ ID NO: 10053321 - DNA, 22 bp, Homo sapiens
ggcaggagctctccagtttgcc

SEQ ID NO: 10053322 - DNA, 22 bp, Homo sapiens
ggcatcagtatggccatagggt

SEQ ID NO: 10053323 - DNA, 22 bp, Homo sapiens
ggcatcttcaaaattgccaaat

SEQ ID NO: 10053324 - DNA, 19 bp, Homo sapiens
ggcgggtggactggagccc

SEQ ID NO: 10053325 - DNA, 22 bp, Homo sapiens
ggccctgctgaagccgggtcta

SEQ ID NO: 10053326 - DNA, 22 bp, Homo sapiens
ggccctgctgagtggagtggag

SEQ ID NO: 10053327 - DNA, 22 bp, Homo sapiens
ggccgtgctccaaagtcatcgt

SEQ ID NO: 10053328 - DNA, 22 bp, Homo sapiens
ggcgtgggcgaggtgctctatc

SEQ ID NO: 10053329 - DNA, 22 bp, Homo sapiens
ggctcctgaggaccaggcacag

SEQ ID NO: 10053330 - DNA, 23 bp, Homo sapiens
ggctctgtgctgggcctgcagga

SEQ ID NO: 10053331 - DNA, 22 bp, Homo sapiens
ggctctggtgtgaagcagcctc

SEQ ID NO: 10053332 - DNA, 17 bp, Homo sapiens
ggctctgggtgtcacat

SEQ ID NO: 10053333 - DNA, 22 bp, Homo sapiens
ggctgctgggtcatgatgcaga

SEQ ID NO: 10053334 - DNA, 23 bp, Homo sapiens
ggctggtgcccttggccagtcgg

SEQ ID NO: 10053335 - DNA, 22 bp, Homo sapiens
ggctggtgagttcagagaaccc

SEQ ID NO: 10053336 - DNA, 22 bp, Homo sapiens
ggctggtggggaaagaggacca

SEQ ID NO: 10053337 - DNA, 22 bp, Homo sapiens
gggaagggagggcctccagtca

SEQ ID NO: 10053338 - DNA, 22 bp, Homo sapiens
gggaagggtgttgtcttatctt

SEQ ID NO: 10053339 - DNA, 22 bp, Homo sapiens
gggagctgagctggaagagaat

SEQ ID NO: 10053340 - DNA, 22 bp, Homo sapiens
gggagctgagctctgagccacg

SEQ ID NO: 10053341 - DNA, 21 bp, Homo sapiens
gggagctgacagcagcacggc

SEQ ID NO: 10053342 - DNA, 22 bp, Homo sapiens
gggagctggagctggaagactc

SEQ ID NO: 10053343 - DNA, 22 bp, Homo sapiens
gggaagggagggacctcagtct

SEQ ID NO: 10053344 - DNA, 22 bp, Homo sapiens
gggagctggagctggaagactc

SEQ ID NO: 10053345 - DNA, 22 bp, Homo sapiens
gggaggtgattaggaccatgta

SEQ ID NO: 10053346 - DNA, 22 bp, Homo sapiens
gggcactgagtggatgatgcag

SEQ ID NO: 10053347 - DNA, 22 bp, Homo sapiens
gggcactgagtggatgatgcag

SEQ ID NO: 10053348 - DNA, 22 bp, Homo sapiens
gggcaccagcggccgcactgcc

SEQ ID NO: 10053349 - DNA, 22 bp, Homo sapiens
gtaatctcagctacttgggagg

SEQ ID NO: 10053350 - DNA, 20 bp, Homo sapiens
gtaatgaatgtaaacagtaa

SEQ ID NO: 10053351 - DNA, 22 bp, Homo sapiens
gtaatctcagctacttgggagg

SEQ ID NO: 10053352 - DNA, 22 bp, Homo sapiens
gtaataatttgctacctggtgg

SEQ ID NO: 10053353 - DNA, 17 bp, Homo sapiens
gtaaggcttgcagatgc

SEQ ID NO: 10053354 - DNA, 22 bp, Homo sapiens
gtaaatattccctcggttccta

SEQ ID NO: 10053355 - DNA, 22 bp, Homo sapiens
ggtgggcagctcttggcaggca

SEQ ID NO: 10053356 - DNA, 23 bp, Homo sapiens
gtaatgatgggaatttacttaga

SEQ ID NO: 10053357 - DNA, 22 bp, Homo sapiens
gtagatgagctcacatgacctt

SEQ ID NO: 10053358 - DNA, 22 bp, Homo sapiens
gtagcagcttcagcccaaatta

SEQ ID NO: 10053359 - DNA, 16 bp, Homo sapiens
gtagccgtggccgctg

SEQ ID NO: 10053360 - DNA, 22 bp, Homo sapiens
gtagcagctctgagcatgctgc

SEQ ID NO: 10053361 - DNA, 22 bp, Homo sapiens
gtagcagctctccagggttcac

SEQ ID NO: 10053362 - DNA, 22 bp, Homo sapiens
gtagcagcagagcaggtcctcc

SEQ ID NO: 10053363 - DNA, 22 bp, Homo sapiens
gtcaacaaggtttgcttatctt

SEQ ID NO: 10053364 - DNA, 22 bp, Homo sapiens
gtcaacaagtagttttcttcca

SEQ ID NO: 10053365 - DNA, 22 bp, Homo sapiens
gtcaacaagtggttattgggat

SEQ ID NO: 10053366 - DNA, 22 bp, Homo sapiens
gtcaacaattccagtttttact

SEQ ID NO: 10053367 - DNA, 22 bp, Homo sapiens
gtaggaaagtaaatgaaataca

SEQ ID NO: 10053368 - DNA, 22 bp, Homo sapiens
gtcatttctgtttcttcagtgc

SEQ ID NO: 10053369 - DNA, 22 bp, Homo sapiens
gtcatttatcatcagaagtcat

SEQ ID NO: 10053370 - DNA, 22 bp, Homo sapiens
gtcacaggtgtggaggtgctgg

SEQ ID NO: 10053371 - DNA, 22 bp, Homo sapiens
gtcaccaggtctgatgcagcca

SEQ ID NO: 10053372 - DNA, 22 bp, Homo sapiens
gtcacagtggggtcacagtgtg

SEQ ID NO: 10053373 - DNA, 22 bp, Homo sapiens
gtcacagtgtatctcttcagct

SEQ ID NO: 10053374 - DNA, 22 bp, Homo sapiens
gtgataactcaggcagagaata

SEQ ID NO: 10053375 - DNA, 22 bp, Homo sapiens
gtgctgggtgctgcagacaggt

SEQ ID NO: 10053376 - DNA, 22 bp, Homo sapiens
gtgctgggattacaggtgtgag

SEQ ID NO: 10053377 - DNA, 22 bp, Homo sapiens
gtgctgggctccaccccagagg

SEQ ID NO: 10053378 - DNA, 22 bp, Homo sapiens
gtgctgggccctgagaccaggg

SEQ ID NO: 10053379 - DNA, 22 bp, Homo sapiens
gtgccgcgacgcagtcggtgcc

SEQ ID NO: 10053380 - DNA, 22 bp, Homo sapiens
gtgccctgggccttcagggcca

SEQ ID NO: 10053381 - DNA, 22 bp, Homo sapiens
gtgccctggtccccagcatata

SEQ ID NO: 10053382 - DNA, 22 bp, Homo sapiens
gtgccctgagtgggtaggagag

SEQ ID NO: 10053383 - DNA, 22 bp, Homo sapiens
ggtgcagtggtgtggcaaaggg

SEQ ID NO: 10053384 - DNA, 22 bp, Homo sapiens
ggtcttgtttatataaggtggt

SEQ ID NO: 10053385 - DNA, 22 bp, Homo sapiens
ggtctggggcaggcatctgaca

SEQ ID NO: 10053386 - DNA, 22 bp, Homo sapiens
ggtggctgcaatggctaacttc

SEQ ID NO: 10053387 - DNA, 22 bp, Homo sapiens
ggtgggagagctctgtctccag

SEQ ID NO: 10053388 - DNA, 22 bp, Homo sapiens
ggtgccagcctagtgcagtggt

SEQ ID NO: 10053389 - DNA, 22 bp, Homo sapiens
ggtggctctgttgtcaactgat

SEQ ID NO: 10053390 - DNA, 22 bp, Homo sapiens
ggtccagggaactttgaaggat

SEQ ID NO: 10053391 - DNA, 22 bp, Homo sapiens
ggtaccaccaattcagctgcca

SEQ ID NO: 10053392 - DNA, 22 bp, Homo sapiens
ggtaaaatgcagattcttagcc

SEQ ID NO: 10053393 - DNA, 22 bp, Homo sapiens
gggtagtgtggtctctgggctg

SEQ ID NO: 10053394 - DNA, 22 bp, Homo sapiens
gggggcggagcacgtgaccacg

SEQ ID NO: 10053395 - DNA, 23 bp, Homo sapiens
gggggccgtcctggggattatag

SEQ ID NO: 10053396 - DNA, 22 bp, Homo sapiens
gggggcagtaaggatatggaaa

SEQ ID NO: 10053397 - DNA, 22 bp, Homo sapiens
gggggagctagtccagctgagg

SEQ ID NO: 10053398 - DNA, 22 bp, Homo sapiens
gggggagctacaggtcccttgg

SEQ ID NO: 10053399 - DNA, 22 bp, Homo sapiens
ggggcaggagcccttcttcagc

SEQ ID NO: 10053400 - DNA, 22 bp, Homo sapiens
gggggaagactgggctagtgat

SEQ ID NO: 10053401 - DNA, 22 bp, Homo sapiens
gggctgggcatggtgttccctc

SEQ ID NO: 10053402 - DNA, 22 bp, Homo sapiens
gggctggctgattttcctctct

SEQ ID NO: 10053403 - DNA, 22 bp, Homo sapiens
gggctccagccagctccttgtg

SEQ ID NO: 10053404 - DNA, 22 bp, Homo sapiens
gggctccagccagctccttgtg

SEQ ID NO: 10053405 - DNA, 22 bp, Homo sapiens
gggctccatcggacttgggttt

SEQ ID NO: 10053406 - DNA, 22 bp, Homo sapiens
gggcctctccggcctttgcatc

SEQ ID NO: 10053407 - DNA, 22 bp, Homo sapiens
gcagtcagacaggaggagctcc

SEQ ID NO: 10053408 - DNA, 22 bp, Homo sapiens
gcagtcctcgtaaaggtcgaag

SEQ ID NO: 10053409 - DNA, 22 bp, Homo sapiens
gcagtcctcctgcctcagcctc

SEQ ID NO: 10053410 - DNA, 22 bp, Homo sapiens
gcagtcctcatcctttagcagt

SEQ ID NO: 10053411 - DNA, 22 bp, Homo sapiens
gcagtcctgggattctgtcctt

SEQ ID NO: 10053412 - DNA, 20 bp, Homo sapiens
gcagtctgcctctgtgtggt

SEQ ID NO: 10053413 - DNA, 22 bp, Homo sapiens
gcatcccaaatctgaaagtcca

SEQ ID NO: 10053414 - DNA, 22 bp, Homo sapiens
gcatttcttcctggtgtgagcc

SEQ ID NO: 10053415 - DNA, 22 bp, Homo sapiens
gccagcaggtggagagatcaag

SEQ ID NO: 10053416 - DNA, 22 bp, Homo sapiens
gccagcagggcggagccatcta

SEQ ID NO: 10053417 - DNA, 22 bp, Homo sapiens
gccagcatcctggtggtggttg

SEQ ID NO: 10053418 - DNA, 22 bp, Homo sapiens
gccagcatcctggtggtggttg

SEQ ID NO: 10053419 - DNA, 22 bp, Homo sapiens
gccagagaggcctaaggccata

SEQ ID NO: 10053420 - DNA, 22 bp, Homo sapiens
gccagagaggccgaggtaccca

SEQ ID NO: 10053421 - DNA, 22 bp, Homo sapiens
gccagagaggcaaatcctagca

SEQ ID NO: 10053422 - DNA, 22 bp, Homo sapiens
gccagagagatggaaaagctta

SEQ ID NO: 10053423 - DNA, 22 bp, Homo sapiens
gccagagagagtccctgggcct

SEQ ID NO: 10053424 - DNA, 22 bp, Homo sapiens
gccagagagactgatacatgct

SEQ ID NO: 10053425 - DNA, 22 bp, Homo sapiens
gcccagagagatgctgtagacc

SEQ ID NO: 10053426 - DNA, 22 bp, Homo sapiens
gcccagagggaagaggtgtcat

SEQ ID NO: 10053427 - DNA, 22 bp, Homo sapiens
gcccagagtgagtcctgggccc

SEQ ID NO: 10053428 - DNA, 18 bp, Homo sapiens
gcccagaggtctgggccc

SEQ ID NO: 10053429 - DNA, 22 bp, Homo sapiens
gccaggaatttcaagagccact

SEQ ID NO: 10053430 - DNA, 22 bp, Homo sapiens
gccaggtgtagtggccacacct

SEQ ID NO: 10053431 - DNA, 22 bp, Homo sapiens
gcctcagagggccctagggaca

SEQ ID NO: 10053432 - DNA, 22 bp, Homo sapiens
gccctgagccaccaatgccatt

SEQ ID NO: 10053433 - DNA, 22 bp, Homo sapiens
gcccagagttcaaggctgcagt

SEQ ID NO: 10053434 - DNA, 22 bp, Homo sapiens
gcccagagtggccacttggctc

SEQ ID NO: 10053435 - DNA, 22 bp, Homo sapiens
gcagccaagaccccaagaactg

SEQ ID NO: 10053436 - DNA, 22 bp, Homo sapiens
gcagcattgcacttttgttctt

SEQ ID NO: 10053437 - DNA, 22 bp, Homo sapiens
gcagcagctgacagtgggtgcc

SEQ ID NO: 10053438 - DNA, 22 bp, Homo sapiens
gcagcaggaataggataagcaa

SEQ ID NO: 10053439 - DNA, 22 bp, Homo sapiens
gcagcagctctgaatgggcccc

SEQ ID NO: 10053440 - DNA, 22 bp, Homo sapiens
gcagcagctgacagtgggtgcc

SEQ ID NO: 10053441 - DNA, 22 bp, Homo sapiens
gcagcagctcagttctgggagg

SEQ ID NO: 10053442 - DNA, 22 bp, Homo sapiens
gcagcagccgacatggattgca

SEQ ID NO: 10053443 - DNA, 22 bp, Homo sapiens
gcagctggccctgacacgcaga

SEQ ID NO: 10053444 - DNA, 22 bp, Homo sapiens
gcagctggatttcaagagggag

SEQ ID NO: 10053445 - DNA, 22 bp, Homo sapiens
gcaggagtatgcagctatggtt

SEQ ID NO: 10053446 - DNA, 22 bp, Homo sapiens
gcaggagtgacatggatgtgga

SEQ ID NO: 10053447 - DNA, 22 bp, Homo sapiens
gcaggctgatagaggattccat

SEQ ID NO: 10053448 - DNA, 22 bp, Homo sapiens
gcaggctgatagaggattccat

SEQ ID NO: 10053449 - DNA, 22 bp, Homo sapiens
gcagggcggcccagagcaggcc

SEQ ID NO: 10053450 - DNA, 22 bp, Homo sapiens
gcaggctccaaggcctgggaga

SEQ ID NO: 10053451 - DNA, 22 bp, Homo sapiens
gcaggctgaaactcggggtcta

SEQ ID NO: 10053452 - DNA, 22 bp, Homo sapiens
gcagagctctgttcttatctcc

SEQ ID NO: 10053453 - DNA, 22 bp, Homo sapiens
gcagagctgagcggctgcccgg

SEQ ID NO: 10053454 - DNA, 22 bp, Homo sapiens
gcagaggagcaagctggacacc

SEQ ID NO: 10053455 - DNA, 22 bp, Homo sapiens
gcactggccgcacgcgtagggc

SEQ ID NO: 10053456 - DNA, 22 bp, Homo sapiens
gcactggattttgatctgcaag

SEQ ID NO: 10053457 - DNA, 22 bp, Homo sapiens
gcactgagtctgtcatgctgca

SEQ ID NO: 10053458 - DNA, 22 bp, Homo sapiens
gcactgcctgtgagccctggtt

SEQ ID NO: 10053459 - DNA, 18 bp, Homo sapiens
gcactctgactgcagagc

SEQ ID NO: 10053460 - DNA, 22 bp, Homo sapiens
gcactgagcaccagccacagat

SEQ ID NO: 10053461 - DNA, 17 bp, Homo sapiens
gcactgagccacagttt

SEQ ID NO: 10053462 - DNA, 22 bp, Homo sapiens
gcactgaggaaggagggagtgg

SEQ ID NO: 10053463 - DNA, 22 bp, Homo sapiens
gcacagctggggtatgatgcca

SEQ ID NO: 10053464 - DNA, 22 bp, Homo sapiens
gcacagctggggtatgatgcca

SEQ ID NO: 10053465 - DNA, 22 bp, Homo sapiens
gcacagctccgcttcctcacac

SEQ ID NO: 10053466 - DNA, 22 bp, Homo sapiens
gcacagctcagtactccctctg

SEQ ID NO: 10053467 - DNA, 22 bp, Homo sapiens
gagggtcccgagccctgtcaga

SEQ ID NO: 10053468 - DNA, 22 bp, Homo sapiens
gcaagaactgcaattacttttg

SEQ ID NO: 10053469 - DNA, 22 bp, Homo sapiens
gcaagaacgaatcctacttgct

SEQ ID NO: 10053470 - DNA, 22 bp, Homo sapiens
gcaagatggttataaaaaatgt

SEQ ID NO: 10053471 - DNA, 22 bp, Homo sapiens
gagggggcgaacagaagcaagg

SEQ ID NO: 10053472 - DNA, 22 bp, Homo sapiens
gagggggacgtatcctggtatg

SEQ ID NO: 10053473 - DNA, 22 bp, Homo sapiens
gagggggagatgtgcacacact

SEQ ID NO: 10053474 - DNA, 22 bp, Homo sapiens
ggacactggccacatttcaaaa

SEQ ID NO: 10053475 - DNA, 20 bp, Homo sapiens
ggacactgtagatttcaaac

SEQ ID NO: 10053476 - DNA, 22 bp, Homo sapiens
ggacactgtataagttagagta

SEQ ID NO: 10053477 - DNA, 23 bp, Homo sapiens
ggacactgtgcagatgctagtgc

SEQ ID NO: 10053478 - DNA, 22 bp, Homo sapiens
ggacactgaagaatctcagatg

SEQ ID NO: 10053479 - DNA, 21 bp, Homo sapiens
ggacactgataatcttgttgc

SEQ ID NO: 10053480 - DNA, 23 bp, Homo sapiens
ggacactgctataaaggatctgc

SEQ ID NO: 10053481 - DNA, 22 bp, Homo sapiens
ggacagagggcaggagcccaga

SEQ ID NO: 10053482 - DNA, 22 bp, Homo sapiens
ggagagagatgccgccttgctc

SEQ ID NO: 10053483 - DNA, 22 bp, Homo sapiens
ggagaggaaatgccagcacttc

SEQ ID NO: 10053484 - DNA, 22 bp, Homo sapiens
ggagaggcgatgagtcacagcc

SEQ ID NO: 10053485 - DNA, 22 bp, Homo sapiens
gctgggtgtcacggggctcgtg

SEQ ID NO: 10053486 - DNA, 22 bp, Homo sapiens
gctgggttttcttccgggccta

SEQ ID NO: 10053487 - DNA, 22 bp, Homo sapiens
gctgggtggatcggaggctctg

SEQ ID NO: 10053488 - DNA, 20 bp, Homo sapiens
gctgggggtgtgctgagtga

SEQ ID NO: 10053489 - DNA, 22 bp, Homo sapiens
gctggggtctgtgaggagggct

SEQ ID NO: 10053490 - DNA, 20 bp, Homo sapiens
gctgggggtgtgctgagtga

SEQ ID NO: 10053491 - DNA, 22 bp, Homo sapiens
gctggggctgggctgaggaaga

SEQ ID NO: 10053492 - DNA, 23 bp, Homo sapiens
gctgtgcacgagccactgcctgt

SEQ ID NO: 10053493 - DNA, 22 bp, Homo sapiens
gcttccaatgcttctatcacat

SEQ ID NO: 10053494 - DNA, 22 bp, Homo sapiens
gcttccaagtcaatcaatgctg

SEQ ID NO: 10053495 - DNA, 22 bp, Homo sapiens
gcttccaagcggtagatagcat

SEQ ID NO: 10053496 - DNA, 22 bp, Homo sapiens
gcttccaaacaaaattttgatg

SEQ ID NO: 10053497 - DNA, 21 bp, Homo sapiens
gcttccaagatggcaccttga

SEQ ID NO: 10053498 - DNA, 22 bp, Homo sapiens
gcttccaaatctgttcaaaatg

SEQ ID NO: 10053499 - DNA, 22 bp, Homo sapiens
gctggcacttgggacaaaatct

SEQ ID NO: 10053500 - DNA, 18 bp, Homo sapiens
gctggctgcacttctgct

SEQ ID NO: 10053501 - DNA, 22 bp, Homo sapiens
gctggctgccttactttgtgga

SEQ ID NO: 10053502 - DNA, 22 bp, Homo sapiens
gctggctgcagattttagaggt

SEQ ID NO: 10053503 - DNA, 22 bp, Homo sapiens
gctgggaagtggcagagctgga

SEQ ID NO: 10053504 - DNA, 22 bp, Homo sapiens
gctgggacggctcagtaagaag

SEQ ID NO: 10053505 - DNA, 22 bp, Homo sapiens
gctgggaaccatgggaaggcag

SEQ ID NO: 10053506 - DNA, 22 bp, Homo sapiens
gctgggaagagatgcacatgat

SEQ ID NO: 10053507 - DNA, 22 bp, Homo sapiens
gctgggaagagatgcacatgat

SEQ ID NO: 10053508 - DNA, 22 bp, Homo sapiens
gctgggactgagacagtgacct

SEQ ID NO: 10053509 - DNA, 17 bp, Homo sapiens
gctccttctaacttcca

SEQ ID NO: 10053510 - DNA, 22 bp, Homo sapiens
gctccttcaggtggtagctgtt

SEQ ID NO: 10053511 - DNA, 22 bp, Homo sapiens
gctctcactttaggttggaccg

SEQ ID NO: 10053512 - DNA, 22 bp, Homo sapiens
gctctgctgatccgcagccatc

SEQ ID NO: 10053513 - DNA, 22 bp, Homo sapiens
gctctgcccaggaccgtccttg

SEQ ID NO: 10053514 - DNA, 22 bp, Homo sapiens
gctctgcccagtgccctgagac

SEQ ID NO: 10053515 - DNA, 22 bp, Homo sapiens
gctgaagataagtgaagaggct

SEQ ID NO: 10053516 - DNA, 22 bp, Homo sapiens
gctgccagcacagttcagctgt

SEQ ID NO: 10053517 - DNA, 22 bp, Homo sapiens
gctcaagccttctgcccacctc

SEQ ID NO: 10053518 - DNA, 22 bp, Homo sapiens
gcggggggaggaacatcttgca

SEQ ID NO: 10053519 - DNA, 21 bp, Homo sapiens
gctcagctgcttggttcctgt

SEQ ID NO: 10053520 - DNA, 22 bp, Homo sapiens
gctcacagcccaggccagcgtg

SEQ ID NO: 10053521 - DNA, 22 bp, Homo sapiens
gcggccttgtggcggagcaggc

SEQ ID NO: 10053522 - DNA, 22 bp, Homo sapiens
gccttccacctaggcctctgct

SEQ ID NO: 10053523 - DNA, 22 bp, Homo sapiens
gccttccacctaggcctctgct

SEQ ID NO: 10053524 - DNA, 22 bp, Homo sapiens
gcctggggaacttgatcctgtc

SEQ ID NO: 10053525 - DNA, 22 bp, Homo sapiens
gcctggggaacttgatcctgtc

SEQ ID NO: 10053526 - DNA, 22 bp, Homo sapiens
gcctggggtcccttgttggcac

SEQ ID NO: 10053527 - DNA, 22 bp, Homo sapiens
gcctggtggtatcctggcaaga

SEQ ID NO: 10053528 - DNA, 22 bp, Homo sapiens
gccttaggggtcagacagagct

SEQ ID NO: 10053529 - DNA, 22 bp, Homo sapiens
gccttcagagtaccatgtcctc

SEQ ID NO: 10053530 - DNA, 22 bp, Homo sapiens
gccttcagagtaccatgtcctc

SEQ ID NO: 10053531 - DNA, 22 bp, Homo sapiens
gccttcagccctgactggccag

SEQ ID NO: 10053532 - DNA, 22 bp, Homo sapiens
gccttcaggaaatcagtccttg

SEQ ID NO: 10053533 - DNA, 22 bp, Homo sapiens
gccttcaggaaatcagtccttg

SEQ ID NO: 10053534 - DNA, 22 bp, Homo sapiens
gccttcaggagggttccagaca

SEQ ID NO: 10053535 - DNA, 22 bp, Homo sapiens
gccttcaggagggttccagaca

SEQ ID NO: 10053536 - DNA, 22 bp, Homo sapiens
gccttcagcggccgctcgctgc

SEQ ID NO: 10053537 - DNA, 22 bp, Homo sapiens
gccttcaggtgctgccaggcta

SEQ ID NO: 10053538 - DNA, 22 bp, Homo sapiens
gccttcaggtgtccctgtgggc

SEQ ID NO: 10053539 - DNA, 22 bp, Homo sapiens
gccttcagtagtgtcagctgta

SEQ ID NO: 10053540 - DNA, 22 bp, Homo sapiens
gccttcagtagtatcctcatga

SEQ ID NO: 10053541 - DNA, 22 bp, Homo sapiens
tcagcctctctgagtccagacc

SEQ ID NO: 10053542 - DNA, 22 bp, Homo sapiens
tcagcctcctaatttcctgtga

SEQ ID NO: 10053543 - DNA, 22 bp, Homo sapiens
tcagcctacactccaacagcat

SEQ ID NO: 10053544 - DNA, 22 bp, Homo sapiens
tcagccagtgccttgatcttgc

SEQ ID NO: 10053545 - DNA, 22 bp, Homo sapiens
tcagccagtgtgcacctggagt

SEQ ID NO: 10053546 - DNA, 22 bp, Homo sapiens
tcagccagttaaggcttagaca

SEQ ID NO: 10053547 - DNA, 22 bp, Homo sapiens
tcagccagttaagtcaagaaat

SEQ ID NO: 10053548 - DNA, 22 bp, Homo sapiens
tcagccagttgccccagttagt

SEQ ID NO: 10053549 - DNA, 22 bp, Homo sapiens
tcagccagtttgattctatttg

SEQ ID NO: 10053550 - DNA, 22 bp, Homo sapiens
tcagccagtttgtttattccgg

SEQ ID NO: 10053551 - DNA, 23 bp, Homo sapiens
tcagcctcttaggacttctcacc

SEQ ID NO: 10053552 - DNA, 22 bp, Homo sapiens
tcagagtgaggcccagcaatct

SEQ ID NO: 10053553 - DNA, 22 bp, Homo sapiens
tcagagtgaggcgtcaacatga

SEQ ID NO: 10053554 - DNA, 22 bp, Homo sapiens
tcagccagtatttgagtgctca

SEQ ID NO: 10053555 - DNA, 22 bp, Homo sapiens
tcagccagggggagagaatgga

SEQ ID NO: 10053556 - DNA, 22 bp, Homo sapiens
tcagccaggtaatgtggagatg

SEQ ID NO: 10053557 - DNA, 22 bp, Homo sapiens
tcagccagggctctggcctcag

SEQ ID NO: 10053558 - DNA, 22 bp, Homo sapiens
tcagccaggccaggcattcaca

SEQ ID NO: 10053559 - DNA, 22 bp, Homo sapiens
tcagccagggcagagcaggtga

SEQ ID NO: 10053560 - DNA, 22 bp, Homo sapiens
tcagccaggccctaagagattg

SEQ ID NO: 10053561 - DNA, 22 bp, Homo sapiens
tcagaggtagtagcagagttga

SEQ ID NO: 10053562 - DNA, 22 bp, Homo sapiens
tcaggcaccctctattttcatc

SEQ ID NO: 10053563 - DNA, 22 bp, Homo sapiens
tcaggagatgtaaccttagctg

SEQ ID NO: 10053564 - DNA, 22 bp, Homo sapiens
tcaggagcctgaaagaggtcta

SEQ ID NO: 10053565 - DNA, 22 bp, Homo sapiens
tcaggagcagggggaagctctg

SEQ ID NO: 10053566 - DNA, 22 bp, Homo sapiens
tcaggagctcaggctgatggaa

SEQ ID NO: 10053567 - DNA, 22 bp, Homo sapiens
tcaggagctcaggctgatggaa

SEQ ID NO: 10053568 - DNA, 22 bp, Homo sapiens
tcaggctaaccctaggcagaag

SEQ ID NO: 10053569 - DNA, 22 bp, Homo sapiens
tcatcctgaagaacctgcttcc

SEQ ID NO: 10053570 - DNA, 22 bp, Homo sapiens
tcatcccagtgtccatgctcag

SEQ ID NO: 10053571 - DNA, 22 bp, Homo sapiens
tcatcccagaccacttattttc

SEQ ID NO: 10053572 - DNA, 22 bp, Homo sapiens
tcatccagtaccatggaaggca

SEQ ID NO: 10053573 - DNA, 22 bp, Homo sapiens
tcatccagcctcatcaggagct

SEQ ID NO: 10053574 - DNA, 23 bp, Homo sapiens
tcatcaaacagctgctcaagaaa

SEQ ID NO: 10053575 - DNA, 22 bp, Homo sapiens
tcataaagctcttccaaatgta

SEQ ID NO: 10053576 - DNA, 22 bp, Homo sapiens
tcataaagcatttcagcttttg

SEQ ID NO: 10053577 - DNA, 20 bp, Homo sapiens
tcataaagaggaaataaata

SEQ ID NO: 10053578 - DNA, 22 bp, Homo sapiens
tcataaaagtactcatgttcat

SEQ ID NO: 10053579 - DNA, 22 bp, Homo sapiens
tcataaaatgctcctgatattg

SEQ ID NO: 10053580 - DNA, 22 bp, Homo sapiens
tcagtttgctcataggtgaggg

SEQ ID NO: 10053581 - DNA, 22 bp, Homo sapiens
tcagttttcaatttcatcagag

SEQ ID NO: 10053582 - DNA, 19 bp, Homo sapiens
tcagttttagtcatcagtt

SEQ ID NO: 10053583 - DNA, 22 bp, Homo sapiens
tcagtttctaaatcttaccaat

SEQ ID NO: 10053584 - DNA, 22 bp, Homo sapiens
tcagtttcttcatctccctaac

SEQ ID NO: 10053585 - DNA, 22 bp, Homo sapiens
tcagtttctccatcgctccagt

SEQ ID NO: 10053586 - DNA, 22 bp, Homo sapiens
tcataaaaatagactctaaagt

SEQ ID NO: 10053587 - DNA, 22 bp, Homo sapiens
tcataaaaatagactctaaagt

SEQ ID NO: 10053588 - DNA, 22 bp, Homo sapiens
tcagttttctcatctgtaattt

SEQ ID NO: 10053589 - DNA, 22 bp, Homo sapiens
tcagtggattgtagaaggctta

SEQ ID NO: 10053590 - DNA, 22 bp, Homo sapiens
tcacatatttaagaaagttaaa

SEQ ID NO: 10053591 - DNA, 22 bp, Homo sapiens
tcacatcaacattatagcatga

SEQ ID NO: 10053592 - DNA, 22 bp, Homo sapiens
tcacagctaagcttggtcactg

SEQ ID NO: 10053593 - DNA, 22 bp, Homo sapiens
tcacatcattaagacttctcct

SEQ ID NO: 10053594 - DNA, 22 bp, Homo sapiens
tcacagcaccaggatctctcca

SEQ ID NO: 10053595 - DNA, 20 bp, Homo sapiens
tcacagagtagccttgtctg

SEQ ID NO: 10053596 - DNA, 22 bp, Homo sapiens
tcacagagctcacagtttagca

SEQ ID NO: 10053597 - DNA, 22 bp, Homo sapiens
tcacagagttaaaagtttcttt

SEQ ID NO: 10053598 - DNA, 22 bp, Homo sapiens
tcacagcaaatgctgcttctca

SEQ ID NO: 10053599 - DNA, 22 bp, Homo sapiens
tcacagcaaatgctgcttctca

SEQ ID NO: 10053600 - DNA, 22 bp, Homo sapiens
tcacagagttaaaagtttcttt

SEQ ID NO: 10053601 - DNA, 22 bp, Homo sapiens
tcacagagagtgacttgttgct

SEQ ID NO: 10053602 - DNA, 18 bp, Homo sapiens
tcacagacagctgtcttt

SEQ ID NO: 10053603 - DNA, 22 bp, Homo sapiens
tcacagacacattaaacatgtg

SEQ ID NO: 10053604 - DNA, 22 bp, Homo sapiens
tcacagaatttttgcttccagt

SEQ ID NO: 10053605 - DNA, 22 bp, Homo sapiens
tcacacagggtcggaaagagtg

SEQ ID NO: 10053606 - DNA, 22 bp, Homo sapiens
tcacacagtgagaaagtgcgga

SEQ ID NO: 10053607 - DNA, 22 bp, Homo sapiens
tcacacaggtttgcaatgattt

SEQ ID NO: 10053608 - DNA, 22 bp, Homo sapiens
tcaattatttgatatgaaaggg

SEQ ID NO: 10053609 - DNA, 23 bp, Homo sapiens
tcaattatcaatggaaagaagtt

SEQ ID NO: 10053610 - DNA, 22 bp, Homo sapiens
tcaatgtgaattaagaatactt

SEQ ID NO: 10053611 - DNA, 22 bp, Homo sapiens
tcacacagctcctttccttagt

SEQ ID NO: 10053612 - DNA, 22 bp, Homo sapiens
tcacacagcagccccgggtgtt

SEQ ID NO: 10053613 - DNA, 23 bp, Homo sapiens
tcacacagctggtcaggtacaga

SEQ ID NO: 10053614 - DNA, 22 bp, Homo sapiens
tcaatttaaggtactactttgg

SEQ ID NO: 10053615 - DNA, 21 bp, Homo sapiens
tcacacacgtttccaagggca

SEQ ID NO: 10053616 - DNA, 22 bp, Homo sapiens
tcaaaagtggcctgtaaaatct

SEQ ID NO: 10053617 - DNA, 22 bp, Homo sapiens
tcaaaagtttcacatagagata

SEQ ID NO: 10053618 - DNA, 22 bp, Homo sapiens
tcaaaatttcagcactagccct

SEQ ID NO: 10053619 - DNA, 22 bp, Homo sapiens
tcaaacagaaattgttcatgct

SEQ ID NO: 10053620 - DNA, 22 bp, Homo sapiens
tcaaaatcaaagatacttgaaa

SEQ ID NO: 10053621 - DNA, 22 bp, Homo sapiens
tcaaaattaaaccaacgtccag

SEQ ID NO: 10053622 - DNA, 22 bp, Homo sapiens
tcaatacatacaatgtatagtg

SEQ ID NO: 10053623 - DNA, 22 bp, Homo sapiens
tcaatacatacaatgtatagtg

SEQ ID NO: 10053624 - DNA, 22 bp, Homo sapiens
tcaatacttaagcttaattcta

SEQ ID NO: 10053625 - DNA, 22 bp, Homo sapiens
tcaaacagaggaacaattgttt

SEQ ID NO: 10053626 - DNA, 22 bp, Homo sapiens
tcaaacagaggaacaattgttt

SEQ ID NO: 10053627 - DNA, 22 bp, Homo sapiens
tcaaacagcaggtctttcatag

SEQ ID NO: 10053628 - DNA, 22 bp, Homo sapiens
tcaaacaggactacattctcat

SEQ ID NO: 10053629 - DNA, 22 bp, Homo sapiens
tcaaacaggactacattctcat

SEQ ID NO: 10053630 - DNA, 22 bp, Homo sapiens
tcaaacatgttagcagtctgtg

SEQ ID NO: 10053631 - DNA, 22 bp, Homo sapiens
tcagagacaccagagagctgtg

SEQ ID NO: 10053632 - DNA, 22 bp, Homo sapiens
tcagagaagtaaggtggggtgc

SEQ ID NO: 10053633 - DNA, 23 bp, Homo sapiens
tcagagaagttgtaggctgggga

SEQ ID NO: 10053634 - DNA, 22 bp, Homo sapiens
tcagaagcatgtggggagcctg

SEQ ID NO: 10053635 - DNA, 22 bp, Homo sapiens
tcagaagagctggtgctgcctg

SEQ ID NO: 10053636 - DNA, 22 bp, Homo sapiens
tcagaacattaaggatttgaag

SEQ ID NO: 10053637 - DNA, 22 bp, Homo sapiens
tcagaacattgacattcttatt

SEQ ID NO: 10053638 - DNA, 22 bp, Homo sapiens
tcagagactggtctgcagatgc

SEQ ID NO: 10053639 - DNA, 22 bp, Homo sapiens
tcagagagcctcaggcactgcc

SEQ ID NO: 10053640 - DNA, 22 bp, Homo sapiens
tcagagagctggtgggcagagg

SEQ ID NO: 10053641 - DNA, 23 bp, Homo sapiens
tcagagagctgttgagagctgcc

SEQ ID NO: 10053642 - DNA, 22 bp, Homo sapiens
tcacatgccctacctaatctta

SEQ ID NO: 10053643 - DNA, 22 bp, Homo sapiens
tcacatgcacatacttcctgtg

SEQ ID NO: 10053644 - DNA, 22 bp, Homo sapiens
tcaccggcagacgtggcctgat

SEQ ID NO: 10053645 - DNA, 22 bp, Homo sapiens
tcacccatgtgtctcccttata

SEQ ID NO: 10053646 - DNA, 23 bp, Homo sapiens
tcagaacagttcttggtgcatag

SEQ ID NO: 10053647 - DNA, 22 bp, Homo sapiens
tcagaacatcctggtttaaaat

SEQ ID NO: 10053648 - DNA, 22 bp, Homo sapiens
tcagaacatcccagatagtaga

SEQ ID NO: 10053649 - DNA, 22 bp, Homo sapiens
tcactaagtgccgagtttagtt

SEQ ID NO: 10053650 - DNA, 22 bp, Homo sapiens
tcactaaagttggagaagagct

SEQ ID NO: 10053651 - DNA, 23 bp, Homo sapiens
tcactaaagtgtttagtgcagat

SEQ ID NO: 10053652 - DNA, 22 bp, Homo sapiens
tcactaagttacatttagtatt

SEQ ID NO: 10053653 - DNA, 22 bp, Homo sapiens
tccacgtgagcttcgtgtgcag

SEQ ID NO: 10053654 - DNA, 22 bp, Homo sapiens
tccacgtgagcttcgtgtgcag

SEQ ID NO: 10053655 - DNA, 22 bp, Homo sapiens
tccactgctcattccacaggca

SEQ ID NO: 10053656 - DNA, 22 bp, Homo sapiens
tccacacttgctgtctgctgag

SEQ ID NO: 10053657 - DNA, 20 bp, Homo sapiens
tcatgtgtgtcctacagaga

SEQ ID NO: 10053658 - DNA, 22 bp, Homo sapiens
tcatggctggaagctcagttag

SEQ ID NO: 10053659 - DNA, 22 bp, Homo sapiens
tccaggagctcatccacgtcaa

SEQ ID NO: 10053660 - DNA, 22 bp, Homo sapiens
tccaggactttcttaaggcact

SEQ ID NO: 10053661 - DNA, 21 bp, Homo sapiens
tccaggacttgagaattccag

SEQ ID NO: 10053662 - DNA, 22 bp, Homo sapiens
tccaggacttggcaggagatga

SEQ ID NO: 10053663 - DNA, 22 bp, Homo sapiens
tccaggacttagtgacctaaaa

SEQ ID NO: 10053664 - DNA, 22 bp, Homo sapiens
tccaggacctgactgggcctgc

SEQ ID NO: 10053665 - DNA, 22 bp, Homo sapiens
tccaggactagcatttctgata

SEQ ID NO: 10053666 - DNA, 22 bp, Homo sapiens
tccaggactataggaaagacac

SEQ ID NO: 10053667 - DNA, 22 bp, Homo sapiens
tccaggacctcccaggctagag

SEQ ID NO: 10053668 - DNA, 22 bp, Homo sapiens
tccaggacagagtagaagcagc

SEQ ID NO: 10053669 - DNA, 22 bp, Homo sapiens
tccagaaaattttacagtgcct

SEQ ID NO: 10053670 - DNA, 22 bp, Homo sapiens
tccagaaatgcaagccaggtgt

SEQ ID NO: 10053671 - DNA, 22 bp, Homo sapiens
tccagcccatccctagcctggg

SEQ ID NO: 10053672 - DNA, 22 bp, Homo sapiens
tccagcccctcctgagccaagc

SEQ ID NO: 10053673 - DNA, 17 bp, Homo sapiens
tccagccctgcccgacg

SEQ ID NO: 10053674 - DNA, 22 bp, Homo sapiens
tccagccctctggcccgcggtg

SEQ ID NO: 10053675 - DNA, 22 bp, Homo sapiens
tcccagagtgtgggcatcaagg

SEQ ID NO: 10053676 - DNA, 22 bp, Homo sapiens
tcccagagtgtgggcatcaagg

SEQ ID NO: 10053677 - DNA, 22 bp, Homo sapiens
tcccactgagcccctgctggtg

SEQ ID NO: 10053678 - DNA, 22 bp, Homo sapiens
tcccacagtggtacagccctga

SEQ ID NO: 10053679 - DNA, 22 bp, Homo sapiens
tccagtgtgtgtccagctgctg

SEQ ID NO: 10053680 - DNA, 19 bp, Homo sapiens
tccagtgtagctggtcatt

SEQ ID NO: 10053681 - DNA, 22 bp, Homo sapiens
tccagtgtacaaaagctatctt

SEQ ID NO: 10053682 - DNA, 22 bp, Homo sapiens
tcccactgtgaatccaaggcct

SEQ ID NO: 10053683 - DNA, 22 bp, Homo sapiens
tcccactgtctgtcttgctgca

SEQ ID NO: 10053684 - DNA, 22 bp, Homo sapiens
tcccactgtcttctcgtgctcg

SEQ ID NO: 10053685 - DNA, 22 bp, Homo sapiens
tcccactgctttgctctgctca

SEQ ID NO: 10053686 - DNA, 22 bp, Homo sapiens
tcccactggacgtctgtgctgg

SEQ ID NO: 10053687 - DNA, 22 bp, Homo sapiens
tcccagattcttctgtgtgggc

SEQ ID NO: 10053688 - DNA, 22 bp, Homo sapiens
tccagggagagccgctgctcca

SEQ ID NO: 10053689 - DNA, 22 bp, Homo sapiens
tccagggagatactggctgcca

SEQ ID NO: 10053690 - DNA, 22 bp, Homo sapiens
tccagggagcaagtcaggccgg

SEQ ID NO: 10053691 - DNA, 22 bp, Homo sapiens
tccagtcctagaaactggagag

SEQ ID NO: 10053692 - DNA, 22 bp, Homo sapiens
tcccttcatcagtgagcaagcc

SEQ ID NO: 10053693 - DNA, 22 bp, Homo sapiens
tcccaggattttaggctctcag

SEQ ID NO: 10053694 - DNA, 22 bp, Homo sapiens
tcctcctctatcagacagtgcc

SEQ ID NO: 10053695 - DNA, 22 bp, Homo sapiens
tccgcccgcacgtatggagtgg

SEQ ID NO: 10053696 - DNA, 22 bp, Homo sapiens
tcctccagctactaggcaaata

SEQ ID NO: 10053697 - DNA, 22 bp, Homo sapiens
tcctccacgtgagggcatacag

SEQ ID NO: 10053698 - DNA, 22 bp, Homo sapiens
tattcacatgaaaacaaatttt

SEQ ID NO: 10053699 - DNA, 22 bp, Homo sapiens
tattcagagtattccatgaggt

SEQ ID NO: 10053700 - DNA, 22 bp, Homo sapiens
tattcagagtgtagcaaataga

SEQ ID NO: 10053701 - DNA, 22 bp, Homo sapiens
tattcactgtaactcagcaata

SEQ ID NO: 10053702 - DNA, 22 bp, Homo sapiens
tattcactttgggagagccatt

SEQ ID NO: 10053703 - DNA, 22 bp, Homo sapiens
tattcagaaaataaattggatt

SEQ ID NO: 10053704 - DNA, 22 bp, Homo sapiens
tattcagaataaagactacatt

SEQ ID NO: 10053705 - DNA, 17 bp, Homo sapiens
tatgtgtgtgtttatac

SEQ ID NO: 10053706 - DNA, 22 bp, Homo sapiens
tatgctaatgacactctagaaa

SEQ ID NO: 10053707 - DNA, 22 bp, Homo sapiens
tatgctaaatatgttcacattg

SEQ ID NO: 10053708 - DNA, 22 bp, Homo sapiens
tatgccactgctctccatccta

SEQ ID NO: 10053709 - DNA, 22 bp, Homo sapiens
tatgttcagaagaagaatgggg

SEQ ID NO: 10053710 - DNA, 22 bp, Homo sapiens
tatgttattttcatacaacaga

SEQ ID NO: 10053711 - DNA, 22 bp, Homo sapiens
tatgtttacgctggtagaatta

SEQ ID NO: 10053712 - DNA, 22 bp, Homo sapiens
tatttcaacgtatgaaaagctg

SEQ ID NO: 10053713 - DNA, 22 bp, Homo sapiens
tatttccagcagtaagaagaca

SEQ ID NO: 10053714 - DNA, 22 bp, Homo sapiens
tatattaaatgaccagttttaa

SEQ ID NO: 10053715 - DNA, 22 bp, Homo sapiens
tatattaacacccacttgcctc

SEQ ID NO: 10053716 - DNA, 22 bp, Homo sapiens
tatattaaatgaccagttttaa

SEQ ID NO: 10053717 - DNA, 22 bp, Homo sapiens
tatattaaaccctctctgtagg

SEQ ID NO: 10053718 - DNA, 22 bp, Homo sapiens
tatattaaaccctctctgtagg

SEQ ID NO: 10053719 - DNA, 22 bp, Homo sapiens
tatattaaagtgctttgcagtg

SEQ ID NO: 10053720 - DNA, 22 bp, Homo sapiens
tatatgtttcttacaaaatatt

SEQ ID NO: 10053721 - DNA, 22 bp, Homo sapiens
tatattaacacccacttgcctc

SEQ ID NO: 10053722 - DNA, 22 bp, Homo sapiens
tatattacctgcctgatctata

SEQ ID NO: 10053723 - DNA, 22 bp, Homo sapiens
tatatgatgccaaataacctgt

SEQ ID NO: 10053724 - DNA, 22 bp, Homo sapiens
tatagcaactccaaagagactt

SEQ ID NO: 10053725 - DNA, 22 bp, Homo sapiens
tatagacaagcgtaacaagaag

SEQ ID NO: 10053726 - DNA, 22 bp, Homo sapiens
tatatgtaagctatgtaagagt

SEQ ID NO: 10053727 - DNA, 22 bp, Homo sapiens
tatatggatagtgatcataaga

SEQ ID NO: 10053728 - DNA, 22 bp, Homo sapiens
tatatgtagtcagtcagagtaa

SEQ ID NO: 10053729 - DNA, 22 bp, Homo sapiens
tatatgtagattgtaccaatgt

SEQ ID NO: 10053730 - DNA, 20 bp, Homo sapiens
tatactaacatatatctgtt

SEQ ID NO: 10053731 - DNA, 22 bp, Homo sapiens
tatactctgagaaacgtgtcac

SEQ ID NO: 10053732 - DNA, 22 bp, Homo sapiens
tatagaacaagttatttatgct

SEQ ID NO: 10053733 - DNA, 22 bp, Homo sapiens
tatacttatgctaaaaaatgtt

SEQ ID NO: 10053734 - DNA, 22 bp, Homo sapiens
tatcaaaggctatgtgattttt

SEQ ID NO: 10053735 - DNA, 22 bp, Homo sapiens
tatcaaagttgtcctgtgaagt

SEQ ID NO: 10053736 - DNA, 19 bp, Homo sapiens
tatatttgttgaataaaaa

SEQ ID NO: 10053737 - DNA, 22 bp, Homo sapiens
tatatttaatcctagagccatt

SEQ ID NO: 10053738 - DNA, 22 bp, Homo sapiens
tatctttagaggaagagaatct

SEQ ID NO: 10053739 - DNA, 22 bp, Homo sapiens
tatctttaacttgcagtattta

SEQ ID NO: 10053740 - DNA, 20 bp, Homo sapiens
tatcttactttagtcatttg

SEQ ID NO: 10053741 - DNA, 22 bp, Homo sapiens
tatgagttgtggcttagtcaca

SEQ ID NO: 10053742 - DNA, 22 bp, Homo sapiens
taggaagatgagtatcaacttg

SEQ ID NO: 10053743 - DNA, 22 bp, Homo sapiens
tagtatttcctgtaagctatag

SEQ ID NO: 10053744 - DNA, 22 bp, Homo sapiens
tagtattcagcttctcaggcaa

SEQ ID NO: 10053745 - DNA, 22 bp, Homo sapiens
tagtccttgctgggcacagagt

SEQ ID NO: 10053746 - DNA, 22 bp, Homo sapiens
tagtaaaaggtcttcctttgtt

SEQ ID NO: 10053747 - DNA, 22 bp, Homo sapiens
tagtataattgttctggaatca

SEQ ID NO: 10053748 - DNA, 22 bp, Homo sapiens
tagcaccacttcatgctttcag

SEQ ID NO: 10053749 - DNA, 22 bp, Homo sapiens
tagcaccatgatggaagagctg

SEQ ID NO: 10053750 - DNA, 22 bp, Homo sapiens
tagccacatgcagactttcatg

SEQ ID NO: 10053751 - DNA, 21 bp, Homo sapiens
tagccatgttccttatggttc

SEQ ID NO: 10053752 - DNA, 22 bp, Homo sapiens
tagcaaaaaaactggcatctcc

SEQ ID NO: 10053753 - DNA, 22 bp, Homo sapiens
tagcaaaaactgcagttacttt

SEQ ID NO: 10053754 - DNA, 22 bp, Homo sapiens
tagcaaaagccacgattacttt

SEQ ID NO: 10053755 - DNA, 21 bp, Homo sapiens
tagcacagctgtagacagttt

SEQ ID NO: 10053756 - DNA, 22 bp, Homo sapiens
tagcacagtatttctcaactgg

SEQ ID NO: 10053757 - DNA, 22 bp, Homo sapiens
tagaagctcaggaataggcata

SEQ ID NO: 10053758 - DNA, 22 bp, Homo sapiens
tactttcatgggttttctttat

SEQ ID NO: 10053759 - DNA, 22 bp, Homo sapiens
tactttctttctgatccttatg

SEQ ID NO: 10053760 - DNA, 22 bp, Homo sapiens
tagagctgataatgaggccaag

SEQ ID NO: 10053761 - DNA, 22 bp, Homo sapiens
tagagctgagttgactccattt

SEQ ID NO: 10053762 - DNA, 22 bp, Homo sapiens
tagagctgataatgaggccaag

SEQ ID NO: 10053763 - DNA, 22 bp, Homo sapiens
gtgctttgttaagtctgaaatt

SEQ ID NO: 10053764 - DNA, 22 bp, Homo sapiens
gtgtgtgtatctgcctatcaca

SEQ ID NO: 10053765 - DNA, 22 bp, Homo sapiens
gtgtgtgtctccgcggccgtag

SEQ ID NO: 10053766 - DNA, 22 bp, Homo sapiens
gtgtgtgtgcatctcttttatt

SEQ ID NO: 10053767 - DNA, 22 bp, Homo sapiens
gtgtgtgtgcatctcttttatt

SEQ ID NO: 10053768 - DNA, 22 bp, Homo sapiens
gtgtgtgtgcatataacatata

SEQ ID NO: 10053769 - DNA, 22 bp, Homo sapiens
gtgttacatattctaaaatgct

SEQ ID NO: 10053770 - DNA, 22 bp, Homo sapiens
gtgtgtgttcaataaatttaag

SEQ ID NO: 10053771 - DNA, 22 bp, Homo sapiens
gtgtgtttagcattagcagggg

SEQ ID NO: 10053772 - DNA, 22 bp, Homo sapiens
gtgtgtgtgcctgcacacacac

SEQ ID NO: 10053773 - DNA, 22 bp, Homo sapiens
gtgtgtgtgtaaaaatccagag

SEQ ID NO: 10053774 - DNA, 22 bp, Homo sapiens
gttataaaggtgataatggtca

SEQ ID NO: 10053775 - DNA, 22 bp, Homo sapiens
gttataaatacctaataggatt

SEQ ID NO: 10053776 - DNA, 22 bp, Homo sapiens
gttataaaatgcacagttgttt

SEQ ID NO: 10053777 - DNA, 22 bp, Homo sapiens
gttagaaagtgtctgcttgggt

SEQ ID NO: 10053778 - DNA, 22 bp, Homo sapiens
gtttaattcccacacctgccct

SEQ ID NO: 10053779 - DNA, 22 bp, Homo sapiens
gtttataaggcccaatatttct

SEQ ID NO: 10053780 - DNA, 22 bp, Homo sapiens
gtttagaatggcaaaattaagt

SEQ ID NO: 10053781 - DNA, 22 bp, Homo sapiens
gtttagaacacggaaatactga

SEQ ID NO: 10053782 - DNA, 22 bp, Homo sapiens
gtttatatgaacttcataccca

SEQ ID NO: 10053783 - DNA, 22 bp, Homo sapiens
gtttctctgtctgttacattgg

SEQ ID NO: 10053784 - DNA, 22 bp, Homo sapiens
taaacagcctaaaactttcttt

SEQ ID NO: 10053785 - DNA, 22 bp, Homo sapiens
taaacagagtgctagttcacgg

SEQ ID NO: 10053786 - DNA, 22 bp, Homo sapiens
taaacagcctcccctttcactc

SEQ ID NO: 10053787 - DNA, 22 bp, Homo sapiens
taaacagagatgcctgggtctg

SEQ ID NO: 10053788 - DNA, 22 bp, Homo sapiens
taaacagagaagactttgagca

SEQ ID NO: 10053789 - DNA, 22 bp, Homo sapiens
taaacagagagtgcagttatag

SEQ ID NO: 10053790 - DNA, 22 bp, Homo sapiens
gttttcaattataagatggctt

SEQ ID NO: 10053791 - DNA, 22 bp, Homo sapiens
taaacagaattcaggcaagata

SEQ ID NO: 10053792 - DNA, 22 bp, Homo sapiens
taaacagctactgtgtcaaagg

SEQ ID NO: 10053793 - DNA, 22 bp, Homo sapiens
gttttataattgcttcataaga

SEQ ID NO: 10053794 - DNA, 17 bp, Homo sapiens
taaatacacaagggtat

SEQ ID NO: 10053795 - DNA, 21 bp, Homo sapiens
taaataataagttgctgagat

SEQ ID NO: 10053796 - DNA, 22 bp, Homo sapiens
taaagtttatttgaacatctct

SEQ ID NO: 10053797 - DNA, 22 bp, Homo sapiens
taaagttcttagaacaaggcct

SEQ ID NO: 10053798 - DNA, 22 bp, Homo sapiens
taaagacaatttcgagctgtag

SEQ ID NO: 10053799 - DNA, 22 bp, Homo sapiens
taaagacacccagggagggact

SEQ ID NO: 10053800 - DNA, 22 bp, Homo sapiens
taaagacaatttcgagctgtag

SEQ ID NO: 10053801 - DNA, 22 bp, Homo sapiens
taaagacactggttttaatcat

SEQ ID NO: 10053802 - DNA, 22 bp, Homo sapiens
taaagacaaatgacattacggc

SEQ ID NO: 10053803 - DNA, 22 bp, Homo sapiens
taaagacaataggaaagttgtt

SEQ ID NO: 10053804 - DNA, 22 bp, Homo sapiens
taaagacaataggaaagttgtt

SEQ ID NO: 10053805 - DNA, 22 bp, Homo sapiens
taaagacaaacccactagggtt

SEQ ID NO: 10053806 - DNA, 22 bp, Homo sapiens
taaagacaaacccactagggtt

SEQ ID NO: 10053807 - DNA, 22 bp, Homo sapiens
taagatgaaggctcacctagaa

SEQ ID NO: 10053808 - DNA, 22 bp, Homo sapiens
taagataaggaacattctgtga

SEQ ID NO: 10053809 - DNA, 22 bp, Homo sapiens
taacacaaaagaatatgtgtgt

SEQ ID NO: 10053810 - DNA, 22 bp, Homo sapiens
taacaatgcaaaatgaatttag

SEQ ID NO: 10053811 - DNA, 21 bp, Homo sapiens
taacaatctctacttctcatt

SEQ ID NO: 10053812 - DNA, 22 bp, Homo sapiens
taaatacagtcatttgagccat

SEQ ID NO: 10053813 - DNA, 22 bp, Homo sapiens
taacaatacccattctaattac

SEQ ID NO: 10053814 - DNA, 22 bp, Homo sapiens
tacgcctgtaatcccagcactt

SEQ ID NO: 10053815 - DNA, 22 bp, Homo sapiens
tacgggcacgcaccacgatgcc

SEQ ID NO: 10053816 - DNA, 22 bp, Homo sapiens
taccttgtgagctttctaacat

SEQ ID NO: 10053817 - DNA, 22 bp, Homo sapiens
taccttcaccagcgaatgtttg

SEQ ID NO: 10053818 - DNA, 22 bp, Homo sapiens
tacttcattcctttgtaaaatg

SEQ ID NO: 10053819 - DNA, 20 bp, Homo sapiens
tactggagtgagcctgtagc

SEQ ID NO: 10053820 - DNA, 22 bp, Homo sapiens
tactgcatagacactgggatat

SEQ ID NO: 10053821 - DNA, 18 bp, Homo sapiens
tacaggaaaagtgttaca

SEQ ID NO: 10053822 - DNA, 22 bp, Homo sapiens
tacaggaactgggcaggacatt

SEQ ID NO: 10053823 - DNA, 22 bp, Homo sapiens
tacatacaagatgtgtttaaaa

SEQ ID NO: 10053824 - DNA, 22 bp, Homo sapiens
tacagttacgctgagaaacgaa

SEQ ID NO: 10053825 - DNA, 17 bp, Homo sapiens
tacaggagagcaggaac

SEQ ID NO: 10053826 - DNA, 22 bp, Homo sapiens
tacagttaccctggaaagaaat

SEQ ID NO: 10053827 - DNA, 22 bp, Homo sapiens
tacattcatggtgacttgtatg

SEQ ID NO: 10053828 - DNA, 22 bp, Homo sapiens
tacattatttcatcagtcatct

SEQ ID NO: 10053829 - DNA, 22 bp, Homo sapiens
tacattatcttgttatctttca

SEQ ID NO: 10053830 - DNA, 22 bp, Homo sapiens
tacacccacattgagcatggga

SEQ ID NO: 10053831 - DNA, 22 bp, Homo sapiens
tacacattctagggcacagtta

SEQ ID NO: 10053832 - DNA, 22 bp, Homo sapiens
tacacattacataatactatct

SEQ ID NO: 10053833 - DNA, 22 bp, Homo sapiens
tacacataggtctgaataaaaa

SEQ ID NO: 10053834 - DNA, 21 bp, Homo sapiens
tacacaaagcgtggtccagag

SEQ ID NO: 10053835 - DNA, 22 bp, Homo sapiens
tacaatgattagctaacttgcc

SEQ ID NO: 10053836 - DNA, 22 bp, Homo sapiens
tacaatgagctgtacatctcca

SEQ ID NO: 10053837 - DNA, 22 bp, Homo sapiens
tacaagctcacaaatttttaag

SEQ ID NO: 10053838 - DNA, 22 bp, Homo sapiens
taataaatgaaagtgctggcat

SEQ ID NO: 10053839 - DNA, 22 bp, Homo sapiens
taatgaggaaatagagggaatg

SEQ ID NO: 10053840 - DNA, 22 bp, Homo sapiens
taatgaggcaagagtcatggct

SEQ ID NO: 10053841 - DNA, 22 bp, Homo sapiens
taatgaggcatttgagtcacct

SEQ ID NO: 10053842 - DNA, 22 bp, Homo sapiens
taatgaatgagaatataacaga

SEQ ID NO: 10053843 - DNA, 22 bp, Homo sapiens
taatgaggtgatgactaaggtc

SEQ ID NO: 10053844 - DNA, 22 bp, Homo sapiens
taatgatgcagttactgtctca

SEQ ID NO: 10053845 - DNA, 22 bp, Homo sapiens
taatttcaatagcttgcataat

SEQ ID NO: 10053846 - DNA, 22 bp, Homo sapiens
taatttcacagttcaacgcaca

SEQ ID NO: 10053847 - DNA, 22 bp, Homo sapiens
taatgcttaattttcacaagcc

SEQ ID NO: 10053848 - DNA, 22 bp, Homo sapiens
taatgcttttccttcaaataag

SEQ ID NO: 10053849 - DNA, 22 bp, Homo sapiens
ttaccacacttatttacattgg

SEQ ID NO: 10053850 - DNA, 22 bp, Homo sapiens
ttacccagggaccaagagaaac

SEQ ID NO: 10053851 - DNA, 20 bp, Homo sapiens
ttacagaaatgatgttattt

SEQ ID NO: 10053852 - DNA, 22 bp, Homo sapiens
cctttacacatggaatgggtct

SEQ ID NO: 10053853 - DNA, 22 bp, Homo sapiens
ttatgtatggatggctgaaagt

SEQ ID NO: 10053854 - DNA, 22 bp, Homo sapiens
ttattattttgtgtacagcaaa

SEQ ID NO: 10053855 - DNA, 22 bp, Homo sapiens
tgttgctcttttttaggtgagt

SEQ ID NO: 10053856 - DNA, 22 bp, Homo sapiens
cctgctcagccccagctcaccc

SEQ ID NO: 10053857 - DNA, 22 bp, Homo sapiens
tgtttataccttggtataacca

SEQ ID NO: 10053858 - DNA, 22 bp, Homo sapiens
tgtttatacctgcaacctgtca

SEQ ID NO: 10053859 - DNA, 22 bp, Homo sapiens
tgtttatacctgcaacctgtca

SEQ ID NO: 10053860 - DNA, 22 bp, Homo sapiens
cctggggagccgcctgagcccc

SEQ ID NO: 10053861 - DNA, 23 bp, Homo sapiens
cctggggagctgtatccagagtg

SEQ ID NO: 10053862 - DNA, 22 bp, Homo sapiens
cctggggagagaaagcccagcc

SEQ ID NO: 10053863 - DNA, 22 bp, Homo sapiens
cctggggagagaaagcccagcc

SEQ ID NO: 10053864 - DNA, 22 bp, Homo sapiens
tgtttctgggtgtgtctcacct

SEQ ID NO: 10053865 - DNA, 20 bp, Homo sapiens
tgtttctgacggtaggagag

SEQ ID NO: 10053866 - DNA, 17 bp, Homo sapiens
tgttttcattcattgct

SEQ ID NO: 10053867 - DNA, 22 bp, Homo sapiens
ttaatatgctgcttcttgaaaa

SEQ ID NO: 10053868 - DNA, 22 bp, Homo sapiens
cctgtacatctgctctcattgc

SEQ ID NO: 10053869 - DNA, 22 bp, Homo sapiens
cctgtacatggccatctttacc

SEQ ID NO: 10053870 - DNA, 22 bp, Homo sapiens
cctgtacattagctgtgaattg

SEQ ID NO: 10053871 - DNA, 22 bp, Homo sapiens
cctgtacagtgaatgaatgtga

SEQ ID NO: 10053872 - DNA, 22 bp, Homo sapiens
ttaaaatgaatattgattagca

SEQ ID NO: 10053873 - DNA, 22 bp, Homo sapiens
ttaaaatgaatattgattagca

SEQ ID NO: 10053874 - DNA, 22 bp, Homo sapiens
ttaaaatctaaagcagttgtct

SEQ ID NO: 10053875 - DNA, 22 bp, Homo sapiens
ttaaaagagcagcccagcatat

SEQ ID NO: 10053876 - DNA, 22 bp, Homo sapiens
ttacaagtttctggcttcatcc

SEQ ID NO: 10053877 - DNA, 22 bp, Homo sapiens
ttacaagtatttaagatgctgt

SEQ ID NO: 10053878 - DNA, 22 bp, Homo sapiens
ttacaagtactgaatatgattt

SEQ ID NO: 10053879 - DNA, 21 bp, Homo sapiens
ttacaaagctacagatgttgc

SEQ ID NO: 10053880 - DNA, 22 bp, Homo sapiens
ttaatgaatgtgtgctaacgtt

SEQ ID NO: 10053881 - DNA, 22 bp, Homo sapiens
ttaatgaaaggcagtttggaac

SEQ ID NO: 10053882 - DNA, 22 bp, Homo sapiens
ttaatgaaacattgactatgat

SEQ ID NO: 10053883 - DNA, 22 bp, Homo sapiens
ttcttcccagccagcacagccc

SEQ ID NO: 10053884 - DNA, 20 bp, Homo sapiens
ctcagaaaagctaaggagaa

SEQ ID NO: 10053885 - DNA, 22 bp, Homo sapiens
ttctcttttgtgatgtgagatg

SEQ ID NO: 10053886 - DNA, 22 bp, Homo sapiens
ttctctttttgcatctcaacct

SEQ ID NO: 10053887 - DNA, 22 bp, Homo sapiens
ttctctttttgcatctcaacct

SEQ ID NO: 10053888 - DNA, 22 bp, Homo sapiens
ttctgaaaattgggtcatactt

SEQ ID NO: 10053889 - DNA, 22 bp, Homo sapiens
ttcttaatacctattttctacc

SEQ ID NO: 10053890 - DNA, 22 bp, Homo sapiens
ttcttaatctgtgtgggttcga

SEQ ID NO: 10053891 - DNA, 22 bp, Homo sapiens
ttcttaatcccacaaatcttca

SEQ ID NO: 10053892 - DNA, 23 bp, Homo sapiens
ttcttacaaggctggcccacttg

SEQ ID NO: 10053893 - DNA, 22 bp, Homo sapiens
ttgcacagagtggatattcagt

SEQ ID NO: 10053894 - DNA, 22 bp, Homo sapiens
ttgctgccttccgaatcctctc

SEQ ID NO: 10053895 - DNA, 22 bp, Homo sapiens
ttgctgcctgaggagcaacact

SEQ ID NO: 10053896 - DNA, 23 bp, Homo sapiens
ttgctgcctgagccttcctctgg

SEQ ID NO: 10053897 - DNA, 22 bp, Homo sapiens
ttgctgccagcgccctgcaggg

SEQ ID NO: 10053898 - DNA, 21 bp, Homo sapiens
ttgctgccctccctttcctca

SEQ ID NO: 10053899 - DNA, 22 bp, Homo sapiens
ctcagccatgtcatgcctacct

SEQ ID NO: 10053900 - DNA, 22 bp, Homo sapiens
ctcagccagacatgacccagtc

SEQ ID NO: 10053901 - DNA, 22 bp, Homo sapiens
ttgcaaaagcaattgcagtttt

SEQ ID NO: 10053902 - DNA, 22 bp, Homo sapiens
ctcagaaacggagctgccattt

SEQ ID NO: 10053903 - DNA, 22 bp, Homo sapiens
ttgatattctgagaagctgaag

SEQ ID NO: 10053904 - DNA, 22 bp, Homo sapiens
ctcagaaagcaatctggtgagg

SEQ ID NO: 10053905 - DNA, 22 bp, Homo sapiens
ttctcattctgactcagtgtag

SEQ ID NO: 10053906 - DNA, 20 bp, Homo sapiens
ctaactaaccactttctgat

SEQ ID NO: 10053907 - DNA, 22 bp, Homo sapiens
ctacataaatatttatgtgtct

SEQ ID NO: 10053908 - DNA, 22 bp, Homo sapiens
ttcagtttccacttacatttaa

SEQ ID NO: 10053909 - DNA, 22 bp, Homo sapiens
ttcagtttcagtcttgcaaaaa

SEQ ID NO: 10053910 - DNA, 22 bp, Homo sapiens
ttcagtttctaaatgctcctct

SEQ ID NO: 10053911 - DNA, 22 bp, Homo sapiens
ttcagtttcgttatctatgaga

SEQ ID NO: 10053912 - DNA, 22 bp, Homo sapiens
ttcagtttccctaaagccaatt

SEQ ID NO: 10053913 - DNA, 21 bp, Homo sapiens
ttcagtttcttcctcatctat

SEQ ID NO: 10053914 - DNA, 22 bp, Homo sapiens
cggctggtgtcgggcacagcaa

SEQ ID NO: 10053915 - DNA, 22 bp, Homo sapiens
cggctggtgtcgggcacagcaa

SEQ ID NO: 10053916 - DNA, 22 bp, Homo sapiens
cgtcccgggttcacgccattct

SEQ ID NO: 10053917 - DNA, 22 bp, Homo sapiens
ttcctaaaagaatacactggat

SEQ ID NO: 10053918 - DNA, 21 bp, Homo sapiens
ttcctcctctggagaagaaga

SEQ ID NO: 10053919 - DNA, 22 bp, Homo sapiens
ctgaggaagacagcagctgtgt

SEQ ID NO: 10053920 - DNA, 22 bp, Homo sapiens
ctgagctgtcaggaatggaaag

SEQ ID NO: 10053921 - DNA, 22 bp, Homo sapiens
ctgagctgtgctaagtgaaatg

SEQ ID NO: 10053922 - DNA, 22 bp, Homo sapiens
ctgagctgtggaataaacactg

SEQ ID NO: 10053923 - DNA, 21 bp, Homo sapiens
ctgagctggggtgaaggttgc

SEQ ID NO: 10053924 - DNA, 22 bp, Homo sapiens
ctgagctggtgtttcagggtca

SEQ ID NO: 10053925 - DNA, 22 bp, Homo sapiens
ctgagcacagaaataagatatt

SEQ ID NO: 10053926 - DNA, 22 bp, Homo sapiens
ctgagctgggcaactcttagat

SEQ ID NO: 10053927 - DNA, 22 bp, Homo sapiens
ctgagctgggagtagagactct

SEQ ID NO: 10053928 - DNA, 22 bp, Homo sapiens
ctgaataattttctgttgtatg

SEQ ID NO: 10053929 - DNA, 22 bp, Homo sapiens
ctgagaggtaagcagcgcagtg

SEQ ID NO: 10053930 - DNA, 22 bp, Homo sapiens
ctgagaggtgctggtggctgca

SEQ ID NO: 10053931 - DNA, 22 bp, Homo sapiens
ttttctctatattgtctgtgaa

SEQ ID NO: 10053932 - DNA, 22 bp, Homo sapiens
ttttctctacaaaataaccagc

SEQ ID NO: 10053933 - DNA, 22 bp, Homo sapiens
ttttctctacaaaataaccagc

SEQ ID NO: 10053934 - DNA, 22 bp, Homo sapiens
ttttctccccagagaccatcat

SEQ ID NO: 10053935 - DNA, 22 bp, Homo sapiens
ttttctcccgctggctgctctt

SEQ ID NO: 10053936 - DNA, 17 bp, Homo sapiens
ttttctcctgcccattc

SEQ ID NO: 10053937 - DNA, 22 bp, Homo sapiens
tttttctagaccttaaaggcca

SEQ ID NO: 10053938 - DNA, 22 bp, Homo sapiens
tttttctcttctgtaaagtggt

SEQ ID NO: 10053939 - DNA, 18 bp, Homo sapiens
ctgaaggatccaggtgta

SEQ ID NO: 10053940 - DNA, 22 bp, Homo sapiens
ctgaaggagcatagtcagtttt

SEQ ID NO: 10053941 - DNA, 22 bp, Homo sapiens
ctgaaggacttggtgatagttg

SEQ ID NO: 10053942 - DNA, 22 bp, Homo sapiens
ctgaaggaagcaggtggcctgt

SEQ ID NO: 10053943 - DNA, 22 bp, Homo sapiens
ctgaaggatttagttctttgct

SEQ ID NO: 10053944 - DNA, 22 bp, Homo sapiens
tttttcttgtgctggatctaat

SEQ ID NO: 10053945 - DNA, 22 bp, Homo sapiens
tttttcttaaatgtgggttggc

SEQ ID NO: 10053946 - DNA, 22 bp, Homo sapiens
ctgaaagaataagatgtttaca

SEQ ID NO: 10053947 - DNA, 22 bp, Homo sapiens
ctgccctgagtcatgccagatg

SEQ ID NO: 10053948 - DNA, 22 bp, Homo sapiens
ctgcagtttcagcctttctggc

SEQ ID NO: 10053949 - DNA, 22 bp, Homo sapiens
ctgcctgccttggcctccagga

SEQ ID NO: 10053950 - DNA, 22 bp, Homo sapiens
ctgctcctgtccagcagggcca

SEQ ID NO: 10053951 - DNA, 22 bp, Homo sapiens
ctgctgcttttgcgggagaaca

SEQ ID NO: 10053952 - DNA, 22 bp, Homo sapiens
ctgctgcttagcatagcagagg

SEQ ID NO: 10053953 - DNA, 22 bp, Homo sapiens
ctgctgccttccaaaggccagg

SEQ ID NO: 10053954 - DNA, 22 bp, Homo sapiens
ctgctgcctgattgcagacctc

SEQ ID NO: 10053955 - DNA, 22 bp, Homo sapiens
ctgctgcctgacaatttaggtt

SEQ ID NO: 10053956 - DNA, 22 bp, Homo sapiens
ctgctgcctagtccaagacgtg

SEQ ID NO: 10053957 - DNA, 22 bp, Homo sapiens
ctgctgcctcgacattgggaca

SEQ ID NO: 10053958 - DNA, 22 bp, Homo sapiens
ctgctggcttctagtcattcaa

SEQ ID NO: 10053959 - DNA, 22 bp, Homo sapiens
ctgctcggcgcgcatggctgcc

SEQ ID NO: 10053960 - DNA, 19 bp, Homo sapiens
ctgctgccggagactcgtc

SEQ ID NO: 10053961 - DNA, 22 bp, Homo sapiens
ctgctgccggcgagcctccctt

SEQ ID NO: 10053962 - DNA, 20 bp, Homo sapiens
ctgctgccctgtcagcctct

SEQ ID NO: 10053963 - DNA, 22 bp, Homo sapiens
ctgctgccctagacccagtcct

SEQ ID NO: 10053964 - DNA, 22 bp, Homo sapiens
ctgctgcccctgagctcagcct

SEQ ID NO: 10053965 - DNA, 22 bp, Homo sapiens
ctcggggatccatccacgtggc

SEQ ID NO: 10053966 - DNA, 22 bp, Homo sapiens
ctcgggcttgaggctgtttacc

SEQ ID NO: 10053967 - DNA, 22 bp, Homo sapiens
ctccttcctggttagcacctta

SEQ ID NO: 10053968 - DNA, 22 bp, Homo sapiens
ctcctgtgattcatttaacata

SEQ ID NO: 10053969 - DNA, 22 bp, Homo sapiens
tttatatgtttgtacaattaag

SEQ ID NO: 10053970 - DNA, 22 bp, Homo sapiens
ctcctgtcaataggctcctggc

SEQ ID NO: 10053971 - DNA, 22 bp, Homo sapiens
ctcctgtcagaagcatcctgag

SEQ ID NO: 10053972 - DNA, 22 bp, Homo sapiens
tttacaattggttttctctaat

SEQ ID NO: 10053973 - DNA, 22 bp, Homo sapiens
ctcccttcaggagaggctcaca

SEQ ID NO: 10053974 - DNA, 22 bp, Homo sapiens
ctcccttcaggagaggctcaca

SEQ ID NO: 10053975 - DNA, 22 bp, Homo sapiens
ctcccaggttgattctttccct

SEQ ID NO: 10053976 - DNA, 22 bp, Homo sapiens
ttgtttatcgcttgctcacata

SEQ ID NO: 10053977 - DNA, 22 bp, Homo sapiens
ttgtttatggattgtagaaact

SEQ ID NO: 10053978 - DNA, 22 bp, Homo sapiens
ttgtttatgtaattggcacact

SEQ ID NO: 10053979 - DNA, 22 bp, Homo sapiens
ttgtttatggattgtagaaact

SEQ ID NO: 10053980 - DNA, 22 bp, Homo sapiens
ttgtttatgtgttgtctatggc

SEQ ID NO: 10053981 - DNA, 22 bp, Homo sapiens
ttgtttattagcaattatcctg

SEQ ID NO: 10053982 - DNA, 20 bp, Homo sapiens
ttgtttattatgttctgatc

SEQ ID NO: 10053983 - DNA, 18 bp, Homo sapiens
tttgaaggatggcctgga

SEQ ID NO: 10053984 - DNA, 22 bp, Homo sapiens
tttgaagtccatctggcccagt

SEQ ID NO: 10053985 - DNA, 19 bp, Homo sapiens
ctctggagtcattgctccc

SEQ ID NO: 10053986 - DNA, 22 bp, Homo sapiens
ctctggaggtcaggtgtggtgg

SEQ ID NO: 10053987 - DNA, 22 bp, Homo sapiens
tttcttcttgagtaaccagatt

SEQ ID NO: 10053988 - DNA, 22 bp, Homo sapiens
tttcttcttgatttaaacaggg

SEQ ID NO: 10053989 - DNA, 21 bp, Homo sapiens
ctctgctgtctaccagctgtt

SEQ ID NO: 10053990 - DNA, 22 bp, Homo sapiens
ctctgctggtagctcattccat

SEQ ID NO: 10053991 - DNA, 22 bp, Homo sapiens
ctctgctgcccaggcctgctag

SEQ ID NO: 10053992 - DNA, 22 bp, Homo sapiens
ctctgctgggatgtaaagtctt

SEQ ID NO: 10053993 - DNA, 20 bp, Homo sapiens
ctctgctgcccgccggctgc

SEQ ID NO: 10053994 - DNA, 22 bp, Homo sapiens
ctctgctgcttgccagtcattg

SEQ ID NO: 10053995 - DNA, 22 bp, Homo sapiens
ctctgagctgaaacatgagcat

SEQ ID NO: 10053996 - DNA, 22 bp, Homo sapiens
tttctgcaggtattgcataagt

SEQ ID NO: 10053997 - DNA, 19 bp, Homo sapiens
tttctgcagcccagcagca

SEQ ID NO: 10053998 - DNA, 22 bp, Homo sapiens
tttctgcaaacttccacgtctc

SEQ ID NO: 10053999 - DNA, 22 bp, Homo sapiens
gactgagaaacagtacattacc

SEQ ID NO: 10054000 - DNA, 22 bp, Homo sapiens
gactgagaatcatagaaggcaa

SEQ ID NO: 10054001 - DNA, 22 bp, Homo sapiens
gactgagaatcatagaaggcaa

SEQ ID NO: 10054002 - DNA, 22 bp, Homo sapiens
gactgaggtattaagatggctt

SEQ ID NO: 10054003 - DNA, 22 bp, Homo sapiens
gaccagaaatcaacacagaatg

SEQ ID NO: 10054004 - DNA, 17 bp, Homo sapiens
gaccaggagaaaccagg

SEQ ID NO: 10054005 - DNA, 22 bp, Homo sapiens
gacagaggagaagatgctgtgg

SEQ ID NO: 10054006 - DNA, 22 bp, Homo sapiens
gacagaggcaagaccagaagcc

SEQ ID NO: 10054007 - DNA, 22 bp, Homo sapiens
gacagagctgctctagattctg

SEQ ID NO: 10054008 - DNA, 22 bp, Homo sapiens
gacagcagcatgtttacaggcc

SEQ ID NO: 10054009 - DNA, 22 bp, Homo sapiens
gacagcagcataatacatgaac

SEQ ID NO: 10054010 - DNA, 22 bp, Homo sapiens
gacagcagatactttcattgaa

SEQ ID NO: 10054011 - DNA, 22 bp, Homo sapiens
gacattgtggttattaaatgtt

SEQ ID NO: 10054012 - DNA, 22 bp, Homo sapiens
gagagggccgggggccagctcc

SEQ ID NO: 10054013 - DNA, 22 bp, Homo sapiens
gagagggccagggtgagaacta

SEQ ID NO: 10054014 - DNA, 22 bp, Homo sapiens
gagagggcaaggtagatgctac

SEQ ID NO: 10054015 - DNA, 22 bp, Homo sapiens
gagagaacacaaagggccagct

SEQ ID NO: 10054016 - DNA, 22 bp, Homo sapiens
gagagggcaaacttgtagctaa

SEQ ID NO: 10054017 - DNA, 22 bp, Homo sapiens
gagactttttaatcactaggaa

SEQ ID NO: 10054018 - DNA, 22 bp, Homo sapiens
gagactttctgatctcactcat

SEQ ID NO: 10054019 - DNA, 22 bp, Homo sapiens
gagactttaaaaaacattaaga

SEQ ID NO: 10054020 - DNA, 22 bp, Homo sapiens
gagacgtggcctttgcctgagc

SEQ ID NO: 10054021 - DNA, 22 bp, Homo sapiens
gaagggtgtgatttgcctgaga

SEQ ID NO: 10054022 - DNA, 22 bp, Homo sapiens
gaaggggaaagttgagcaaata

SEQ ID NO: 10054023 - DNA, 22 bp, Homo sapiens
gaagggctgcaggtctgggccc

SEQ ID NO: 10054024 - DNA, 17 bp, Homo sapiens
gaatccttctctgttct

SEQ ID NO: 10054025 - DNA, 22 bp, Homo sapiens
gaatgacgccctgtggtcactt

SEQ ID NO: 10054026 - DNA, 22 bp, Homo sapiens
gacagacacaattgatccatga

SEQ ID NO: 10054027 - DNA, 22 bp, Homo sapiens
gaaggccagttttgagataggt

SEQ ID NO: 10054028 - DNA, 22 bp, Homo sapiens
gaaggcagggaatgtggtgcta

SEQ ID NO: 10054029 - DNA, 22 bp, Homo sapiens
gaaaggagagggttaaggagct

SEQ ID NO: 10054030 - DNA, 22 bp, Homo sapiens
gaaaggagggaaacagagcggt

SEQ ID NO: 10054031 - DNA, 22 bp, Homo sapiens
gaggaaagctggtttaaagtat

SEQ ID NO: 10054032 - DNA, 22 bp, Homo sapiens
gagctgctggctcctcaggtta

SEQ ID NO: 10054033 - DNA, 22 bp, Homo sapiens
gagcccagcttgcacatggagc

SEQ ID NO: 10054034 - DNA, 22 bp, Homo sapiens
gagccagtgatcagacagggag

SEQ ID NO: 10054035 - DNA, 22 bp, Homo sapiens
gagcccagtaggcaaagctgca

SEQ ID NO: 10054036 - DNA, 22 bp, Homo sapiens
gagcccaggcagaggttgcagt

SEQ ID NO: 10054037 - DNA, 22 bp, Homo sapiens
gagcccaggctggggttcagag

SEQ ID NO: 10054038 - DNA, 22 bp, Homo sapiens
gagaggggcccaagccacatag

SEQ ID NO: 10054039 - DNA, 22 bp, Homo sapiens
gagaggggcgcgcagctcgcga

SEQ ID NO: 10054040 - DNA, 22 bp, Homo sapiens
gagaggggacctgtgtgtctag

SEQ ID NO: 10054041 - DNA, 22 bp, Homo sapiens
gagaggggacctgtgtgtctag

SEQ ID NO: 10054042 - DNA, 22 bp, Homo sapiens
gagcaggctctgcctgtgtgtc

SEQ ID NO: 10054043 - DNA, 22 bp, Homo sapiens
gagaggggtttgccatcctatg

SEQ ID NO: 10054044 - DNA, 22 bp, Homo sapiens
gagaggggtttgccatcctatg

SEQ ID NO: 10054045 - DNA, 22 bp, Homo sapiens
gaggcagcttggggctgtgggt

SEQ ID NO: 10054046 - DNA, 22 bp, Homo sapiens
gaggcaggcagattgcttgagg

SEQ ID NO: 10054047 - DNA, 22 bp, Homo sapiens
gaggcaggaggattgcttgagc

SEQ ID NO: 10054048 - DNA, 22 bp, Homo sapiens
gaggcaggccctgaatgagtca

SEQ ID NO: 10054049 - DNA, 22 bp, Homo sapiens
gagggaggcatcatgaatccag

SEQ ID NO: 10054050 - DNA, 22 bp, Homo sapiens
gaggctgcactggctaaaggct

SEQ ID NO: 10054051 - DNA, 22 bp, Homo sapiens
gaggggctctttaatagtaaca

SEQ ID NO: 10054052 - DNA, 22 bp, Homo sapiens
gaggggctggcacgatggctgc

SEQ ID NO: 10054053 - DNA, 22 bp, Homo sapiens
cttctcaaacctgaaaggacaa

SEQ ID NO: 10054054 - DNA, 22 bp, Homo sapiens
cttctcagagcttccagaaaac

SEQ ID NO: 10054055 - DNA, 22 bp, Homo sapiens
cttctcagtcacctgtgagtct

SEQ ID NO: 10054056 - DNA, 22 bp, Homo sapiens
cttccaagcccaggagccattt

SEQ ID NO: 10054057 - DNA, 22 bp, Homo sapiens
cttccaagatgaacagcaagcg

SEQ ID NO: 10054058 - DNA, 22 bp, Homo sapiens
cttataaagtccatctgaacaa

SEQ ID NO: 10054059 - DNA, 23 bp, Homo sapiens
cttcattgtagtgttggggagat

SEQ ID NO: 10054060 - DNA, 22 bp, Homo sapiens
cttatagaatgtttttatatgt

SEQ ID NO: 10054061 - DNA, 22 bp, Homo sapiens
ctgtttatagcagagcaagcct

SEQ ID NO: 10054062 - DNA, 22 bp, Homo sapiens
ctgtttatcatgtacatttcca

SEQ ID NO: 10054063 - DNA, 22 bp, Homo sapiens
ctgtttatactcaaaagataca

SEQ ID NO: 10054064 - DNA, 22 bp, Homo sapiens
ctgtttataaaccaccagttta

SEQ ID NO: 10054065 - DNA, 22 bp, Homo sapiens
ctgtttttgtgctgtgtctccc

SEQ ID NO: 10054066 - DNA, 22 bp, Homo sapiens
ctgtttttgtgctgtgtctccc

SEQ ID NO: 10054067 - DNA, 22 bp, Homo sapiens
ctgttttccctggagttcagca

SEQ ID NO: 10054068 - DNA, 22 bp, Homo sapiens
cttaatttttgtagtagatgga

SEQ ID NO: 10054069 - DNA, 22 bp, Homo sapiens
cttaatttaaaatagttcaggc

SEQ ID NO: 10054070 - DNA, 22 bp, Homo sapiens
cttacaagcaaaacaactgtag

SEQ ID NO: 10054071 - DNA, 22 bp, Homo sapiens
cttacacagtctggcacttctt

SEQ ID NO: 10054072 - DNA, 22 bp, Homo sapiens
cttagaaatgcagattctcagg

SEQ ID NO: 10054073 - DNA, 22 bp, Homo sapiens
cttagaaatcgaactcaggtta

SEQ ID NO: 10054074 - DNA, 22 bp, Homo sapiens
gaaaattattgaaaatggctct

SEQ ID NO: 10054075 - DNA, 22 bp, Homo sapiens
gaaaatacttcagtgttctggc

SEQ ID NO: 10054076 - DNA, 22 bp, Homo sapiens
gaaacagattaacagcatattt

SEQ ID NO: 10054077 - DNA, 22 bp, Homo sapiens
gaaacacatatgaacagttgat

SEQ ID NO: 10054078 - DNA, 22 bp, Homo sapiens
cttttcttgtattggatgcccc

SEQ ID NO: 10054079 - DNA, 22 bp, Homo sapiens
cttttcttactcccgcaaggca

SEQ ID NO: 10054080 - DNA, 22 bp, Homo sapiens
cttttcttactcccgcaaggca

SEQ ID NO: 10054081 - DNA, 22 bp, Homo sapiens
cttctgaaacccccagtgtggg

SEQ ID NO: 10054082 - DNA, 22 bp, Homo sapiens
cttctcttggtagttcttgttg

SEQ ID NO: 10054083 - DNA, 22 bp, Homo sapiens
cttctgaagtgtttgatgattg

SEQ ID NO: 10054084 - DNA, 22 bp, Homo sapiens
ctttaaataatacaaggtccag

SEQ ID NO: 10054085 - DNA, 22 bp, Homo sapiens
cttgtggagatatccatgtctg

SEQ ID NO: 10054086 - DNA, 22 bp, Homo sapiens
ctttgaaaaatggtttcctaga

SEQ ID NO: 10054087 - DNA, 22 bp, Homo sapiens
ctttctttgtccaccaacaatg

SEQ ID NO: 10054088 - DNA, 22 bp, Homo sapiens
ctttgaaaacacacgaatagac

SEQ ID NO: 10054089 - DNA, 22 bp, Homo sapiens
ctttgaaattcttcagctgaag

SEQ ID NO: 10054090 - DNA, 22 bp, Homo sapiens
ctttacaaactataaagtgcgg

SEQ ID NO: 10054091 - DNA, 22 bp, Homo sapiens
ctttaattaggaagtataatga

SEQ ID NO: 10054092 - DNA, 22 bp, Homo sapiens
ctttaacagttccattcaattt

SEQ ID NO: 10054093 - DNA, 22 bp, Homo sapiens
ctgggcacctttgcagcaggct

SEQ ID NO: 10054094 - DNA, 22 bp, Homo sapiens
ctgggcactgcagcaggcatca

SEQ ID NO: 10054095 - DNA, 22 bp, Homo sapiens
ctgggagattgctagagatgca

SEQ ID NO: 10054096 - DNA, 22 bp, Homo sapiens
ctgggagattgctagagatgca

SEQ ID NO: 10054097 - DNA, 22 bp, Homo sapiens
ctgggcagaattttaggatggc

SEQ ID NO: 10054098 - DNA, 22 bp, Homo sapiens
ctgggcgtgtcttccagctggc

SEQ ID NO: 10054099 - DNA, 22 bp, Homo sapiens
ctgggacacccagagctgcaga

SEQ ID NO: 10054100 - DNA, 22 bp, Homo sapiens
ctgggagatgactcagagcagg

SEQ ID NO: 10054101 - DNA, 22 bp, Homo sapiens
ctgggagattcaggtgaagttt

SEQ ID NO: 10054102 - DNA, 22 bp, Homo sapiens
ctgggacctgtgtgcctgggcc

SEQ ID NO: 10054103 - DNA, 22 bp, Homo sapiens
ctgggacatgatagaaacagat

SEQ ID NO: 10054104 - DNA, 22 bp, Homo sapiens
ctgggacatggtgctgtcttta

SEQ ID NO: 10054105 - DNA, 22 bp, Homo sapiens
ctgggacagagcagcagtgggg

SEQ ID NO: 10054106 - DNA, 22 bp, Homo sapiens
ctgtatttgtcctctatttatt

SEQ ID NO: 10054107 - DNA, 22 bp, Homo sapiens
ctgtctctgttgcctgtaggtg

SEQ ID NO: 10054108 - DNA, 21 bp, Homo sapiens
ctgtcacctgctcagagaggg

SEQ ID NO: 10054109 - DNA, 22 bp, Homo sapiens
ctgtgccctctttgctggcctt

SEQ ID NO: 10054110 - DNA, 22 bp, Homo sapiens
ctgtgctgagtgatgtgactta

SEQ ID NO: 10054111 - DNA, 22 bp, Homo sapiens
ctgtgctgattcagcacaggcc

SEQ ID NO: 10054112 - DNA, 22 bp, Homo sapiens
ctgtctgggtctacatcctctg

SEQ ID NO: 10054113 - DNA, 20 bp, Homo sapiens
ctggtctgccactcacagtt

SEQ ID NO: 10054114 - DNA, 22 bp, Homo sapiens
ctggtgacatttccggctgcca

SEQ ID NO: 10054115 - DNA, 22 bp, Homo sapiens
ctggggagaagcgactcggctg

SEQ ID NO: 10054116 - DNA, 22 bp, Homo sapiens
ctggggaccgagcaagctctgg

SEQ ID NO: 10054117 - DNA, 22 bp, Homo sapiens
ctgtacaggtcaatgataagat

SEQ ID NO: 10054118 - DNA, 22 bp, Homo sapiens
ctgtacaggagacgtctgtgca

SEQ ID NO: 10054119 - DNA, 22 bp, Homo sapiens
ctgtacagcaagttcaccttgg

SEQ ID NO: 10054120 - DNA, 22 bp, Homo sapiens
ctgtacagattgcacacgggga

SEQ ID NO: 10054121 - DNA, 22 bp, Homo sapiens
ctgtacagagttctgagtgtac

SEQ ID NO: 10054122 - DNA, 22 bp, Homo sapiens
ctgtacatatacatttttttcc

SEQ ID NO: 10054123 - DNA, 22 bp, Homo sapiens
ctgtacaggtgaggagggggct

SEQ ID NO: 10054124 - DNA, 19 bp, Homo sapiens
ctgtacaggttgcttctgg

SEQ ID NO: 10054125 - DNA, 22 bp, Homo sapiens
ctgtacagacctattagcccag

SEQ ID NO: 10054126 - DNA, 22 bp, Homo sapiens
ctgtacagaagctagagcaaat

SEQ ID NO: 10054127 - DNA, 22 bp, Homo sapiens
tacagagagataagtgtaaaag

SEQ ID NO: 10054128 - DNA, 22 bp, Homo sapiens
caggccctcctgtgatctgcct

SEQ ID NO: 10054129 - DNA, 22 bp, Homo sapiens
cagctctgccacttcctagcta

SEQ ID NO: 10054130 - DNA, 22 bp, Homo sapiens
cagctctgctgggaggatgcag

SEQ ID NO: 10054131 - DNA, 22 bp, Homo sapiens
gtggagcaggactagctgagaa

SEQ ID NO: 10054132 - DNA, 22 bp, Homo sapiens
tacacagagactcaaaagggca

SEQ ID NO: 10054133 - DNA, 22 bp, Homo sapiens
tacacagaggctgatgtcttag

SEQ ID NO: 10054134 - DNA, 22 bp, Homo sapiens
tacacagaggctgatgtcttag

SEQ ID NO: 10054135 - DNA, 22 bp, Homo sapiens
tacacagaggcagctgtctgct

SEQ ID NO: 10054136 - DNA, 22 bp, Homo sapiens
tacacagatatgtgatcaatca

SEQ ID NO: 10054137 - DNA, 22 bp, Homo sapiens
tacacagaagccagaaggcctg

SEQ ID NO: 10054138 - DNA, 22 bp, Homo sapiens
tacacagactcttcaattcaga

SEQ ID NO: 10054139 - DNA, 22 bp, Homo sapiens
tacacagactcttcaattcaga

SEQ ID NO: 10054140 - DNA, 22 bp, Homo sapiens
tacacagactcttcaattcaga

SEQ ID NO: 10054141 - DNA, 22 bp, Homo sapiens
tacacagatttcagtatcatca

SEQ ID NO: 10054142 - DNA, 22 bp, Homo sapiens
tacacagatttaaaagcaggga

SEQ ID NO: 10054143 - DNA, 22 bp, Homo sapiens
caggccaaagatcccattgaca

SEQ ID NO: 10054144 - DNA, 22 bp, Homo sapiens
tagcagcaattcaggtgtgatg

SEQ ID NO: 10054145 - DNA, 22 bp, Homo sapiens
tagcagcaatttcagaagtttg

SEQ ID NO: 10054146 - DNA, 22 bp, Homo sapiens
tagcagcacagaaagcctggag

SEQ ID NO: 10054147 - DNA, 22 bp, Homo sapiens
tagcagcaagaatgggatgtgt

SEQ ID NO: 10054148 - DNA, 22 bp, Homo sapiens
tagcagcaaagcaggatctgct

SEQ ID NO: 10054149 - DNA, 22 bp, Homo sapiens
cagggatgctgcttaggcagtt

SEQ ID NO: 10054150 - DNA, 22 bp, Homo sapiens
cagggcagtgaagaacacacgt

SEQ ID NO: 10054151 - DNA, 22 bp, Homo sapiens
cagggcagtaccgccctctggc

SEQ ID NO: 10054152 - DNA, 22 bp, Homo sapiens
tagcataacaggtaagagtgag

SEQ ID NO: 10054153 - DNA, 22 bp, Homo sapiens
tagcagcacctacacgtcagag

SEQ ID NO: 10054154 - DNA, 22 bp, Homo sapiens
tacctcaagttccaggaaagcg

SEQ ID NO: 10054155 - DNA, 22 bp, Homo sapiens
cagggacagcgggactctgaca

SEQ ID NO: 10054156 - DNA, 22 bp, Homo sapiens
cagggagaggcatcatagggaa

SEQ ID NO: 10054157 - DNA, 22 bp, Homo sapiens
tcacattctcagcatctataca

SEQ ID NO: 10054158 - DNA, 22 bp, Homo sapiens
tcactgcaacctctgcctcccg

SEQ ID NO: 10054159 - DNA, 22 bp, Homo sapiens
tcactgcaagctcctcctcctg

SEQ ID NO: 10054160 - DNA, 22 bp, Homo sapiens
tcactgcagagacctctagtca

SEQ ID NO: 10054161 - DNA, 22 bp, Homo sapiens
tcactgcagcctctgcctcccg

SEQ ID NO: 10054162 - DNA, 22 bp, Homo sapiens
tcactgcactccagcactcagg

SEQ ID NO: 10054163 - DNA, 22 bp, Homo sapiens
tcacaccagtttcctttcaatt

SEQ ID NO: 10054164 - DNA, 22 bp, Homo sapiens
cagtcccagctgctcagaaggc

SEQ ID NO: 10054165 - DNA, 22 bp, Homo sapiens
cagtctggaggtcagctggctt

SEQ ID NO: 10054166 - DNA, 22 bp, Homo sapiens
cagtcttctaacctagcagcct

SEQ ID NO: 10054167 - DNA, 22 bp, Homo sapiens
cagtcttatcctgaaaacaaca

SEQ ID NO: 10054168 - DNA, 22 bp, Homo sapiens
tcaaatgccagtggtgtggatc

SEQ ID NO: 10054169 - DNA, 22 bp, Homo sapiens
tcaaattagtggaataataatg

SEQ ID NO: 10054170 - DNA, 22 bp, Homo sapiens
tcaaattagtggaataataatg

SEQ ID NO: 10054171 - DNA, 22 bp, Homo sapiens
tcaacaaatacttaaagcagag

SEQ ID NO: 10054172 - DNA, 22 bp, Homo sapiens
tcaaattgtcatcttgataatg

SEQ ID NO: 10054173 - DNA, 22 bp, Homo sapiens
tcaaattttaacatgcattaga

SEQ ID NO: 10054174 - DNA, 22 bp, Homo sapiens
tcaaaggaatttgattttgatg

SEQ ID NO: 10054175 - DNA, 22 bp, Homo sapiens
tcaaaggcccattgtcccgttg

SEQ ID NO: 10054176 - DNA, 22 bp, Homo sapiens
tcaaaggcattgccaataagta

SEQ ID NO: 10054177 - DNA, 22 bp, Homo sapiens
tcaaaggcaccaaggtcactgc

SEQ ID NO: 10054178 - DNA, 20 bp, Homo sapiens
tcaaaggcaaaggtgggtgt

SEQ ID NO: 10054179 - DNA, 19 bp, Homo sapiens
tcaaaggcaaggaggaact

SEQ ID NO: 10054180 - DNA, 22 bp, Homo sapiens
tcaaaggagtttaagttactgg

SEQ ID NO: 10054181 - DNA, 22 bp, Homo sapiens
tcaaaagaaacaccatgttcct

SEQ ID NO: 10054182 - DNA, 22 bp, Homo sapiens
tattcctcccagtaagtacaac

SEQ ID NO: 10054183 - DNA, 22 bp, Homo sapiens
tagtaagcacatggacaagtgg

SEQ ID NO: 10054184 - DNA, 22 bp, Homo sapiens
tagtaagcctctccagagacag

SEQ ID NO: 10054185 - DNA, 22 bp, Homo sapiens
tagtacagttccatcaaagcag

SEQ ID NO: 10054186 - DNA, 22 bp, Homo sapiens
tagtacagtggcattcaaactt

SEQ ID NO: 10054187 - DNA, 22 bp, Homo sapiens
tagtttgagaattgaaatagaa

SEQ ID NO: 10054188 - DNA, 22 bp, Homo sapiens
tagtttgcgaaattcctgcctc

SEQ ID NO: 10054189 - DNA, 22 bp, Homo sapiens
tagtttgtcaaccactgtcaca

SEQ ID NO: 10054190 - DNA, 22 bp, Homo sapiens
tatattcaatgattagtatcag

SEQ ID NO: 10054191 - DNA, 22 bp, Homo sapiens
tatattcaacaggctaatgtca

SEQ ID NO: 10054192 - DNA, 22 bp, Homo sapiens
tatataatttgtaaaagcacct

SEQ ID NO: 10054193 - DNA, 22 bp, Homo sapiens
tatataactactattttgctca

SEQ ID NO: 10054194 - DNA, 22 bp, Homo sapiens
tatataactactattttgctca

SEQ ID NO: 10054195 - DNA, 22 bp, Homo sapiens
caggtggggcagctgtgggagc

SEQ ID NO: 10054196 - DNA, 22 bp, Homo sapiens
caggtggggcgccctcaggcag

SEQ ID NO: 10054197 - DNA, 22 bp, Homo sapiens
caggtggggggcttccgagcct

SEQ ID NO: 10054198 - DNA, 22 bp, Homo sapiens
caggtgggcgtggcgagaaggc

SEQ ID NO: 10054199 - DNA, 22 bp, Homo sapiens
caggtgggctgcctctccagct

SEQ ID NO: 10054200 - DNA, 22 bp, Homo sapiens
caggtgggccggggtttgttct

SEQ ID NO: 10054201 - DNA, 22 bp, Homo sapiens
caggtggcttagtcccatttta

SEQ ID NO: 10054202 - DNA, 22 bp, Homo sapiens
caggtggggagagtgtggagca

SEQ ID NO: 10054203 - DNA, 22 bp, Homo sapiens
caggtgggcttgggagaacact

SEQ ID NO: 10054204 - DNA, 22 bp, Homo sapiens
caggtgggctgcctctccagct

SEQ ID NO: 10054205 - DNA, 22 bp, Homo sapiens
tatgaagaaacctatcctctag

SEQ ID NO: 10054206 - DNA, 22 bp, Homo sapiens
tatgaacatgttcattgactta

SEQ ID NO: 10054207 - DNA, 22 bp, Homo sapiens
tatattcattttaaagccatct

SEQ ID NO: 10054208 - DNA, 22 bp, Homo sapiens
catcaaatctgacttttcttcc

SEQ ID NO: 10054209 - DNA, 22 bp, Homo sapiens
catcagagtcagagctctttct

SEQ ID NO: 10054210 - DNA, 21 bp, Homo sapiens
catcacattactcaaagtcct

SEQ ID NO: 10054211 - DNA, 20 bp, Homo sapiens
tcacttattctcaacttgtg

SEQ ID NO: 10054212 - DNA, 22 bp, Homo sapiens
catcctggttaccccatagtca

SEQ ID NO: 10054213 - DNA, 22 bp, Homo sapiens
catccgcatgcaagtgctgtcc

SEQ ID NO: 10054214 - DNA, 22 bp, Homo sapiens
tcagtttcctcatctacaaaag

SEQ ID NO: 10054215 - DNA, 22 bp, Homo sapiens
tcatcagagctcccccaaacgt

SEQ ID NO: 10054216 - DNA, 19 bp, Homo sapiens
tcatcacccctcctctcta

SEQ ID NO: 10054217 - DNA, 22 bp, Homo sapiens
tcatcacatatgtcatgatttg

SEQ ID NO: 10054218 - DNA, 22 bp, Homo sapiens
catcagagtggtggcctggtgt

SEQ ID NO: 10054219 - DNA, 22 bp, Homo sapiens
catcagtaaggcaacatagctt

SEQ ID NO: 10054220 - DNA, 22 bp, Homo sapiens
catcaggaaaaaactggagcca

SEQ ID NO: 10054221 - DNA, 22 bp, Homo sapiens
catcagtcagtctcttcagtat

SEQ ID NO: 10054222 - DNA, 22 bp, Homo sapiens
catcagtctgaaagccagggag

SEQ ID NO: 10054223 - DNA, 22 bp, Homo sapiens
cattaataaacatttcagaaga

SEQ ID NO: 10054224 - DNA, 22 bp, Homo sapiens
cattacaaacatgttaagattt

SEQ ID NO: 10054225 - DNA, 22 bp, Homo sapiens
cattacaaagttataaacagtt

SEQ ID NO: 10054226 - DNA, 22 bp, Homo sapiens
cattacaaccccaaattacaaa

SEQ ID NO: 10054227 - DNA, 22 bp, Homo sapiens
catgcttcacacactgaatgac

SEQ ID NO: 10054228 - DNA, 22 bp, Homo sapiens
catgctttctgtccaaatgtta

SEQ ID NO: 10054229 - DNA, 20 bp, Homo sapiens
catggtggaggagcagggcc

SEQ ID NO: 10054230 - DNA, 20 bp, Homo sapiens
catggtggaggagcagggcc

SEQ ID NO: 10054231 - DNA, 22 bp, Homo sapiens
catggtttcatgagaattaccc

SEQ ID NO: 10054232 - DNA, 22 bp, Homo sapiens
catgctaaccagagacataaag

SEQ ID NO: 10054233 - DNA, 22 bp, Homo sapiens
catgctaagtcataaaagagta

SEQ ID NO: 10054234 - DNA, 22 bp, Homo sapiens
tccaagatctacagcagtttag

SEQ ID NO: 10054235 - DNA, 17 bp, Homo sapiens
tccagagaggcttccct

SEQ ID NO: 10054236 - DNA, 22 bp, Homo sapiens
tccaagcatgtggtcaggagcc

SEQ ID NO: 10054237 - DNA, 22 bp, Homo sapiens
tccaagcactgttaattaaact

SEQ ID NO: 10054238 - DNA, 22 bp, Homo sapiens
tccaagcaacaactaatttaca

SEQ ID NO: 10054239 - DNA, 22 bp, Homo sapiens
cattttcatgagtttctgttca

SEQ ID NO: 10054240 - DNA, 22 bp, Homo sapiens
cattttctcaatgaaccctctt

SEQ ID NO: 10054241 - DNA, 22 bp, Homo sapiens
catttcagtgttattctaattt

SEQ ID NO: 10054242 - DNA, 22 bp, Homo sapiens
ccaccaggacagccctgagggg

SEQ ID NO: 10054243 - DNA, 22 bp, Homo sapiens
ccacagggcacaagggaggttg

SEQ ID NO: 10054244 - DNA, 22 bp, Homo sapiens
ccacaggcggagtggcgggcag

SEQ ID NO: 10054245 - DNA, 22 bp, Homo sapiens
ccacagctgaccgcaggtgagc

SEQ ID NO: 10054246 - DNA, 22 bp, Homo sapiens
ccacagctgacaatggatagac

SEQ ID NO: 10054247 - DNA, 22 bp, Homo sapiens
tctatacaagtttcactttgac

SEQ ID NO: 10054248 - DNA, 22 bp, Homo sapiens
tctataaattatgcagtctcag

SEQ ID NO: 10054249 - DNA, 22 bp, Homo sapiens
tctataaatgcagatatgtgtg

SEQ ID NO: 10054250 - DNA, 23 bp, Homo sapiens
tctatacatactgcagcctctgg

SEQ ID NO: 10054251 - DNA, 22 bp, Homo sapiens
ccagagaggccttggcaagaca

SEQ ID NO: 10054252 - DNA, 22 bp, Homo sapiens
ccaccaggcactcacagggaag

SEQ ID NO: 10054253 - DNA, 20 bp, Homo sapiens
tcctgtgtgtctcatcaacc

SEQ ID NO: 10054254 - DNA, 22 bp, Homo sapiens
tcctgtgttacccttgcagtga

SEQ ID NO: 10054255 - DNA, 22 bp, Homo sapiens
tctctgtagttgggcagctgct

SEQ ID NO: 10054256 - DNA, 22 bp, Homo sapiens
tctctgtagggctgcttgagta

SEQ ID NO: 10054257 - DNA, 22 bp, Homo sapiens
tctctgtagagacagcactgtg

SEQ ID NO: 10054258 - DNA, 21 bp, Homo sapiens
tctctgtatccatgggttcca

SEQ ID NO: 10054259 - DNA, 22 bp, Homo sapiens
tctctgtatcccagaaccaaaa

SEQ ID NO: 10054260 - DNA, 22 bp, Homo sapiens
tctctgtattctgatattcact

SEQ ID NO: 10054261 - DNA, 22 bp, Homo sapiens
tctctgtacagtacatgccgtg

SEQ ID NO: 10054262 - DNA, 22 bp, Homo sapiens
tctctgtaaaatgtggatgata

SEQ ID NO: 10054263 - DNA, 22 bp, Homo sapiens
ccagaggggcacaaaagtagaa

SEQ ID NO: 10054264 - DNA, 22 bp, Homo sapiens
ccagagggcctttggagttatc

SEQ ID NO: 10054265 - DNA, 22 bp, Homo sapiens
ccagagggaagaggaagcgctg

SEQ ID NO: 10054266 - DNA, 22 bp, Homo sapiens
ccagagcagggcagcagggctc

SEQ ID NO: 10054267 - DNA, 22 bp, Homo sapiens
ccagagcagggcagcagggctc

SEQ ID NO: 10054268 - DNA, 20 bp, Homo sapiens
ccagagcagccactgaagtt

SEQ ID NO: 10054269 - DNA, 22 bp, Homo sapiens
tggcagagaacacacatgattc

SEQ ID NO: 10054270 - DNA, 21 bp, Homo sapiens
tggcagacaggaggagctcac

SEQ ID NO: 10054271 - DNA, 22 bp, Homo sapiens
tggcagaatgaagactggggcc

SEQ ID NO: 10054272 - DNA, 22 bp, Homo sapiens
tggcacttgtcacctgctttca

SEQ ID NO: 10054273 - DNA, 22 bp, Homo sapiens
tggcacttttcccagttttggt

SEQ ID NO: 10054274 - DNA, 22 bp, Homo sapiens
tggcaggctgagttggcctggt

SEQ ID NO: 10054275 - DNA, 22 bp, Homo sapiens
tggaggaataacagcaacctta

SEQ ID NO: 10054276 - DNA, 22 bp, Homo sapiens
tggaggaagttgctggaagtca

SEQ ID NO: 10054277 - DNA, 22 bp, Homo sapiens
tggaggaagtggacagttgtgt

SEQ ID NO: 10054278 - DNA, 22 bp, Homo sapiens
tggagctgaggggaatgctgag

SEQ ID NO: 10054279 - DNA, 21 bp, Homo sapiens
tggagactctggttctttgtg

SEQ ID NO: 10054280 - DNA, 20 bp, Homo sapiens
tggagacaattgcccttttt

SEQ ID NO: 10054281 - DNA, 22 bp, Homo sapiens
tggagacacaggaccagactgc

SEQ ID NO: 10054282 - DNA, 22 bp, Homo sapiens
tgctcagcttcagaggatcccc

SEQ ID NO: 10054283 - DNA, 22 bp, Homo sapiens
tgctacactcaatcagtgctat

SEQ ID NO: 10054284 - DNA, 22 bp, Homo sapiens
tgctacataccacgatgcagta

SEQ ID NO: 10054285 - DNA, 19 bp, Homo sapiens
cccagtctaggtcctagga

SEQ ID NO: 10054286 - DNA, 22 bp, Homo sapiens
tgctcaggtcgttctgcccctt

SEQ ID NO: 10054287 - DNA, 22 bp, Homo sapiens
tgctctgaggcacatgccatcg

SEQ ID NO: 10054288 - DNA, 22 bp, Homo sapiens
tgctgcctgatgctttctggac

SEQ ID NO: 10054289 - DNA, 22 bp, Homo sapiens
tgctctggacgctgagtggttt

SEQ ID NO: 10054290 - DNA, 22 bp, Homo sapiens
ccctccagtgtcccagtgggga

SEQ ID NO: 10054291 - DNA, 22 bp, Homo sapiens
tgctgttgacggactggctgct

SEQ ID NO: 10054292 - DNA, 22 bp, Homo sapiens
cccagtgtgatgaggttgctaa

SEQ ID NO: 10054293 - DNA, 22 bp, Homo sapiens
tgctgcgggacccactgtgggc

SEQ ID NO: 10054294 - DNA, 22 bp, Homo sapiens
tgctgggggctttctggatacc

SEQ ID NO: 10054295 - DNA, 22 bp, Homo sapiens
tgctgggggtgtctcaccaggc

SEQ ID NO: 10054296 - DNA, 22 bp, Homo sapiens
tgctgggggtgtctcaccaggc

SEQ ID NO: 10054297 - DNA, 18 bp, Homo sapiens
tgctggggtagaatccac

SEQ ID NO: 10054298 - DNA, 22 bp, Homo sapiens
ccccagctcagtgcagggacat

SEQ ID NO: 10054299 - DNA, 22 bp, Homo sapiens
tggcttctttgtagaaattgaa

SEQ ID NO: 10054300 - DNA, 19 bp, Homo sapiens
cctctcccatgcttacctc

SEQ ID NO: 10054301 - DNA, 22 bp, Homo sapiens
tgggagagcagagaaccctctt

SEQ ID NO: 10054302 - DNA, 22 bp, Homo sapiens
tgggcactgactgttagtgatg

SEQ ID NO: 10054303 - DNA, 22 bp, Homo sapiens
tgggcactgaagctttgagcag

SEQ ID NO: 10054304 - DNA, 22 bp, Homo sapiens
tgggcactcttctgtgcaaaca

SEQ ID NO: 10054305 - DNA, 22 bp, Homo sapiens
tgggcactgtgtgtggtaaaat

SEQ ID NO: 10054306 - DNA, 22 bp, Homo sapiens
tgggacaggaggcctctggaga

SEQ ID NO: 10054307 - DNA, 22 bp, Homo sapiens
tgggagagaataatcaataggt

SEQ ID NO: 10054308 - DNA, 22 bp, Homo sapiens
tgggagagcactgcagccccgg

SEQ ID NO: 10054309 - DNA, 22 bp, Homo sapiens
tggcagtgtgggaggaaggtac

SEQ ID NO: 10054310 - DNA, 22 bp, Homo sapiens
tggcagtgtcttgctggggcag

SEQ ID NO: 10054311 - DNA, 22 bp, Homo sapiens
tggcagtgtcttatcaggagtg

SEQ ID NO: 10054312 - DNA, 22 bp, Homo sapiens
tggcagtgggaagctggaagtc

SEQ ID NO: 10054313 - DNA, 22 bp, Homo sapiens
tggcagtggctttgctggtgga

SEQ ID NO: 10054314 - DNA, 22 bp, Homo sapiens
tgggtggaataaatcagttctg

SEQ ID NO: 10054315 - DNA, 22 bp, Homo sapiens
tgggtggcagcttcagcatgtt

SEQ ID NO: 10054316 - DNA, 22 bp, Homo sapiens
tggtgggacatctgaggagagg

SEQ ID NO: 10054317 - DNA, 22 bp, Homo sapiens
tggtacttggaggcagaaaaat

SEQ ID NO: 10054318 - DNA, 22 bp, Homo sapiens
tggtactgagaatagcgtctac

SEQ ID NO: 10054319 - DNA, 22 bp, Homo sapiens
tgggcaggcaagtgaatacctt

SEQ ID NO: 10054320 - DNA, 22 bp, Homo sapiens
tgggcaggataatatctcatgt

SEQ ID NO: 10054321 - DNA, 22 bp, Homo sapiens
tgggcaggagagaagctaaaga

SEQ ID NO: 10054322 - DNA, 22 bp, Homo sapiens
tgggccgtggagcactctgaga

SEQ ID NO: 10054323 - DNA, 22 bp, Homo sapiens
tgggctccggcggcctcaggct

SEQ ID NO: 10054324 - DNA, 22 bp, Homo sapiens
tgggctccgttgcctggggcag

SEQ ID NO: 10054325 - DNA, 22 bp, Homo sapiens
tgggctcctcgtcactcgctgt

SEQ ID NO: 10054326 - DNA, 22 bp, Homo sapiens
tgggctccagcacctgtgctct

SEQ ID NO: 10054327 - DNA, 22 bp, Homo sapiens
cctgcaggctgcaggccagttc

SEQ ID NO: 10054328 - DNA, 22 bp, Homo sapiens
cctgcagaccacactcagtcct

SEQ ID NO: 10054329 - DNA, 23 bp, Homo sapiens
ccatcaggcctccgtgtccagcc

SEQ ID NO: 10054330 - DNA, 22 bp, Homo sapiens
tgaggccaggcaaaggcgatct

SEQ ID NO: 10054331 - DNA, 22 bp, Homo sapiens
tgaggccatgcccgtgccggcc

SEQ ID NO: 10054332 - DNA, 17 bp, Homo sapiens
tgaggccatggcaccat

SEQ ID NO: 10054333 - DNA, 22 bp, Homo sapiens
tgagtttggtatctagggggtc

SEQ ID NO: 10054334 - DNA, 22 bp, Homo sapiens
tgagtccatgtggaggggaggt

SEQ ID NO: 10054335 - DNA, 22 bp, Homo sapiens
tgagtccatcgcagggaagtgg

SEQ ID NO: 10054336 - DNA, 22 bp, Homo sapiens
tgagtccattgatggatagtga

SEQ ID NO: 10054337 - DNA, 22 bp, Homo sapiens
tgagtcctgctctgggcagggt

SEQ ID NO: 10054338 - DNA, 22 bp, Homo sapiens
tgagtcctgctgagcagagagg

SEQ ID NO: 10054339 - DNA, 22 bp, Homo sapiens
tgagtccaataggggcctggaa

SEQ ID NO: 10054340 - DNA, 22 bp, Homo sapiens
tgagtccaccttagtatatggg

SEQ ID NO: 10054341 - DNA, 22 bp, Homo sapiens
tgagtccactttaaaatgtcag

SEQ ID NO: 10054342 - DNA, 22 bp, Homo sapiens
tgagtccaagagccagtgggaa

SEQ ID NO: 10054343 - DNA, 22 bp, Homo sapiens
ccatcccttctctggccagcag

SEQ ID NO: 10054344 - DNA, 22 bp, Homo sapiens
tgagccagttcttcagatccat

SEQ ID NO: 10054345 - DNA, 21 bp, Homo sapiens
ccagtgctacagctgcctgac

SEQ ID NO: 10054346 - DNA, 22 bp, Homo sapiens
ccagtgcctatctcctctggga

SEQ ID NO: 10054347 - DNA, 22 bp, Homo sapiens
ccagtgcccagctgcccaggca

SEQ ID NO: 10054348 - DNA, 22 bp, Homo sapiens
tgagcagagacgggggcctcca

SEQ ID NO: 10054349 - DNA, 22 bp, Homo sapiens
ccagggctgctgggggagttga

SEQ ID NO: 10054350 - DNA, 22 bp, Homo sapiens
ccagggctgcctggccgtgtgt

SEQ ID NO: 10054351 - DNA, 22 bp, Homo sapiens
tgagcagtcatccatttctcct

SEQ ID NO: 10054352 - DNA, 22 bp, Homo sapiens
ccagtccagtgccatgcatggc

SEQ ID NO: 10054353 - DNA, 22 bp, Homo sapiens
ccagtccatatttatactgccg

SEQ ID NO: 10054354 - DNA, 20 bp, Homo sapiens
ccagtccacctgagacatgt

SEQ ID NO: 10054355 - DNA, 22 bp, Homo sapiens
ccagtccacgtcaagaagaggt

SEQ ID NO: 10054356 - DNA, 22 bp, Homo sapiens
ccagtcagggcaggagcctggt

SEQ ID NO: 10054357 - DNA, 22 bp, Homo sapiens
ccagtcagtcagttgctggcat

SEQ ID NO: 10054358 - DNA, 22 bp, Homo sapiens
ccagtcagggcaggagcctggt

SEQ ID NO: 10054359 - DNA, 22 bp, Homo sapiens
tgcactgatgttttgccaagga

SEQ ID NO: 10054360 - DNA, 22 bp, Homo sapiens
tgcactccaggctgggtgacag

SEQ ID NO: 10054361 - DNA, 22 bp, Homo sapiens
tgcagagaagaggacagttcta

SEQ ID NO: 10054362 - DNA, 22 bp, Homo sapiens
tgcagagaaagtgtagacaggc

SEQ ID NO: 10054363 - DNA, 22 bp, Homo sapiens
tgcagagagatatggcaagagg

SEQ ID NO: 10054364 - DNA, 22 bp, Homo sapiens
tgcagagacttgtgtgcatttg

SEQ ID NO: 10054365 - DNA, 22 bp, Homo sapiens
tgcagagagccctgccttcctc

SEQ ID NO: 10054366 - DNA, 17 bp, Homo sapiens
cccagagatgctgcctt

SEQ ID NO: 10054367 - DNA, 22 bp, Homo sapiens
cccagagatgggaggtgatcgg

SEQ ID NO: 10054368 - DNA, 22 bp, Homo sapiens
cccagagctccggtcctgccca

SEQ ID NO: 10054369 - DNA, 23 bp, Homo sapiens
cccaagcctgtgccctctgactc

SEQ ID NO: 10054370 - DNA, 22 bp, Homo sapiens
cccaagcctttcaaaactcaga

SEQ ID NO: 10054371 - DNA, 22 bp, Homo sapiens
tgcagccacatgacctgggtct

SEQ ID NO: 10054372 - DNA, 22 bp, Homo sapiens
tgcaggaatgaggttctcagtt

SEQ ID NO: 10054373 - DNA, 20 bp, Homo sapiens
tgcaggaatttgcattcctt

SEQ ID NO: 10054374 - DNA, 22 bp, Homo sapiens
tgcaggaatagctacagagctg

SEQ ID NO: 10054375 - DNA, 22 bp, Homo sapiens
cccagcagcttgcacagtgctg

SEQ ID NO: 10054376 - DNA, 22 bp, Homo sapiens
cccagcaggcatgttgggagga

SEQ ID NO: 10054377 - DNA, 22 bp, Homo sapiens
cccagcagccagaatgaggagc

SEQ ID NO: 10054378 - DNA, 22 bp, Homo sapiens
tcttttgtgaggacaaggtacg

SEQ ID NO: 10054379 - DNA, 22 bp, Homo sapiens
tcttttcttgcattattgcact

SEQ ID NO: 10054380 - DNA, 22 bp, Homo sapiens
tcttttcttgcattattgcact

SEQ ID NO: 10054381 - DNA, 22 bp, Homo sapiens
tctttggtttctgtctctgtaa

SEQ ID NO: 10054382 - DNA, 22 bp, Homo sapiens
tctttggttgcactgcaggtgt

SEQ ID NO: 10054383 - DNA, 22 bp, Homo sapiens
tcttgcacttcatgaatatgtt

SEQ ID NO: 10054384 - DNA, 21 bp, Homo sapiens
tgaaacaatcagacagagtct

SEQ ID NO: 10054385 - DNA, 22 bp, Homo sapiens
tcttttgtgattcttcagttac

SEQ ID NO: 10054386 - DNA, 22 bp, Homo sapiens
tcttttgtgattcttcagttac

SEQ ID NO: 10054387 - DNA, 22 bp, Homo sapiens
tcttttgtgattctttagttac

SEQ ID NO: 10054388 - DNA, 22 bp, Homo sapiens
ccagggctgccgcatccctggt

SEQ ID NO: 10054389 - DNA, 22 bp, Homo sapiens
ccagggatgcagaggttgcagt

SEQ ID NO: 10054390 - DNA, 22 bp, Homo sapiens
ccagggatgccaagctttacca

SEQ ID NO: 10054391 - DNA, 22 bp, Homo sapiens
ccaggcaggcgatggtgcagtg

SEQ ID NO: 10054392 - DNA, 22 bp, Homo sapiens
tcttaattctgtgtcttcacta

SEQ ID NO: 10054393 - DNA, 22 bp, Homo sapiens
tcttaattgagaacagtgtagg

SEQ ID NO: 10054394 - DNA, 22 bp, Homo sapiens
tctgttcatgtctttttaagtg

SEQ ID NO: 10054395 - DNA, 22 bp, Homo sapiens
tctgttcagctgcctcagggta

SEQ ID NO: 10054396 - DNA, 22 bp, Homo sapiens
tctgttcaggtttcagagaact

SEQ ID NO: 10054397 - DNA, 22 bp, Homo sapiens
tctgttcagttgattagacaga

SEQ ID NO: 10054398 - DNA, 20 bp, Homo sapiens
tctgttattgcatgtacata

SEQ ID NO: 10054399 - DNA, 22 bp, Homo sapiens
ccagcactctattgaatattct

SEQ ID NO: 10054400 - DNA, 22 bp, Homo sapiens
ccagcactcctgtctcaagtct

SEQ ID NO: 10054401 - DNA, 22 bp, Homo sapiens
ccagcactcgctgattttagga

SEQ ID NO: 10054402 - DNA, 22 bp, Homo sapiens
tttctatatgaggagctaaagt

SEQ ID NO: 10054403 - DNA, 22 bp, Homo sapiens
tttctattgatctaataaacat

SEQ ID NO: 10054404 - DNA, 22 bp, Homo sapiens
tttgcattgtttcaaaagtgaa

SEQ ID NO: 10054405 - DNA, 21 bp, Homo sapiens
tttgagaattggtcagagtgc

SEQ ID NO: 10054406 - DNA, 22 bp, Homo sapiens
tttgagaatggtaagtggatcg

SEQ ID NO: 10054407 - DNA, 22 bp, Homo sapiens
tttgagaatggtaagtggatcg

SEQ ID NO: 10054408 - DNA, 22 bp, Homo sapiens
tttggcatgggctatttgcttt

SEQ ID NO: 10054409 - DNA, 22 bp, Homo sapiens
ttttcaagagagtgttctatgt

SEQ ID NO: 10054410 - DNA, 22 bp, Homo sapiens
ttttcaattttgaggcagtggt

SEQ ID NO: 10054411 - DNA, 22 bp, Homo sapiens
ttttagaaatactgatttagtg

SEQ ID NO: 10054412 - DNA, 22 bp, Homo sapiens
tttgtcttaaatcttgttactg

SEQ ID NO: 10054413 - DNA, 22 bp, Homo sapiens
tttgtcttccccctttaatcag

SEQ ID NO: 10054414 - DNA, 22 bp, Homo sapiens
ttttacaaatgaggagctggag

SEQ ID NO: 10054415 - DNA, 22 bp, Homo sapiens
tttttgtatatgcttcgaggat

SEQ ID NO: 10054416 - DNA, 17 bp, Homo sapiens
ttttgttcatcttcaaa

SEQ ID NO: 10054417 - DNA, 22 bp, Homo sapiens
ttttgtatagtcaaagacaaga

SEQ ID NO: 10054418 - DNA, 21 bp, Homo sapiens
ttttttcttgcgtgaggcctg

SEQ ID NO: 10054419 - DNA, 22 bp, Homo sapiens
ttatttaatgtgatctgaagag

SEQ ID NO: 10054420 - DNA, 22 bp, Homo sapiens
ttatttaatgtgatctgaagag

SEQ ID NO: 10054421 - DNA, 22 bp, Homo sapiens
ttatttaaaagtggtaagattc

SEQ ID NO: 10054422 - DNA, 22 bp, Homo sapiens
ttattaaaatgcggatttggct

SEQ ID NO: 10054423 - DNA, 22 bp, Homo sapiens
ttcaaaagcggtccaggaagat

SEQ ID NO: 10054424 - DNA, 23 bp, Homo sapiens
ttcaaaactggaaaatcagatgc

SEQ ID NO: 10054425 - DNA, 22 bp, Homo sapiens
ttattttctcctcagaaagtgg

SEQ ID NO: 10054426 - DNA, 22 bp, Homo sapiens
ttcaagactgcgactaatgccc

SEQ ID NO: 10054427 - DNA, 22 bp, Homo sapiens
ttataagctctgaaatctccta

SEQ ID NO: 10054428 - DNA, 22 bp, Homo sapiens
ttataagagtatatagtgtact

SEQ ID NO: 10054429 - DNA, 22 bp, Homo sapiens
ttagtgcttctgtccaaatata

SEQ ID NO: 10054430 - DNA, 22 bp, Homo sapiens
ttagtgcttggcacacaataca

SEQ ID NO: 10054431 - DNA, 22 bp, Homo sapiens
ttagtgtgttaatgagtatatc

SEQ ID NO: 10054432 - DNA, 22 bp, Homo sapiens
ttagtgtgttatataccaagct

SEQ ID NO: 10054433 - DNA, 22 bp, Homo sapiens
ttagtgtgtccagttctgaaaa

SEQ ID NO: 10054434 - DNA, 22 bp, Homo sapiens
ttccatgcctctatttagaatt

SEQ ID NO: 10054435 - DNA, 22 bp, Homo sapiens
ttccaatggaatcatgtcttga

SEQ ID NO: 10054436 - DNA, 20 bp, Homo sapiens
ttccaaggtctatgcttctt

SEQ ID NO: 10054437 - DNA, 22 bp, Homo sapiens
ttccaagtgcccatatttcatc

SEQ ID NO: 10054438 - DNA, 22 bp, Homo sapiens
ttcatattatgatttgaaatgc

SEQ ID NO: 10054439 - DNA, 22 bp, Homo sapiens
ttcatatttgaaacagaagtta

SEQ ID NO: 10054440 - DNA, 22 bp, Homo sapiens
ttcatacatttttactaacagc

SEQ ID NO: 10054441 - DNA, 22 bp, Homo sapiens
ttcagacagtaagaaagaggtt

SEQ ID NO: 10054442 - DNA, 22 bp, Homo sapiens
ttcagaatgtgaccttatttgg

SEQ ID NO: 10054443 - DNA, 22 bp, Homo sapiens
ttcagaatgtactgatagaaca

SEQ ID NO: 10054444 - DNA, 19 bp, Homo sapiens
ttcagaattgggaggtgat

SEQ ID NO: 10054445 - DNA, 16 bp, Homo sapiens
ttcagaatttgtagaa

SEQ ID NO: 10054446 - DNA, 22 bp, Homo sapiens
ttcagaatgctatttctgaaat

SEQ ID NO: 10054447 - DNA, 22 bp, Homo sapiens
ttcagaatgctatttctgaaat

SEQ ID NO: 10054448 - DNA, 22 bp, Homo sapiens
ttcagaatgatttcagcgagca

SEQ ID NO: 10054449 - DNA, 22 bp, Homo sapiens
ttcagaatgattacattctggt

SEQ ID NO: 10054450 - DNA, 22 bp, Homo sapiens
ttcagaatctatgtgccagctc

SEQ ID NO: 10054451 - DNA, 22 bp, Homo sapiens
ttcagaatgagaatggatgggt

SEQ ID NO: 10054452 - DNA, 22 bp, Homo sapiens
ttcagaatgacttatgtaaggc

SEQ ID NO: 10054453 - DNA, 22 bp, Homo sapiens
ttcaatatctctaagaatgagg

SEQ ID NO: 10054454 - DNA, 22 bp, Homo sapiens
ttcaatcattagaatctcaggc

SEQ ID NO: 10054455 - DNA, 22 bp, Homo sapiens
ttcagaacaatatgaacagaac

SEQ ID NO: 10054456 - DNA, 22 bp, Homo sapiens
ttcagaataactttttattgaa

SEQ ID NO: 10054457 - DNA, 22 bp, Homo sapiens
ttcagaatattattttaaaggc

SEQ ID NO: 10054458 - DNA, 22 bp, Homo sapiens
ttcagaatatttgttttacatg

SEQ ID NO: 10054459 - DNA, 22 bp, Homo sapiens
ttcagaatatccgtttaagttt

SEQ ID NO: 10054460 - DNA, 22 bp, Homo sapiens
ttcagaataatgtgttagagaa

SEQ ID NO: 10054461 - DNA, 22 bp, Homo sapiens
ttgaaaatatcacaggagcagc

SEQ ID NO: 10054462 - DNA, 22 bp, Homo sapiens
ttgaaaagttttgaaacactct

SEQ ID NO: 10054463 - DNA, 20 bp, Homo sapiens
ttgaaaatgcattgtgcagt

SEQ ID NO: 10054464 - DNA, 22 bp, Homo sapiens
ttctttttatcttcccataaga

SEQ ID NO: 10054465 - DNA, 22 bp, Homo sapiens
ttctttttaaagtgtgtatgca

SEQ ID NO: 10054466 - DNA, 22 bp, Homo sapiens
ttgaaaagcaaatgatgggtag

SEQ ID NO: 10054467 - DNA, 22 bp, Homo sapiens
ttgaaaaaattggtagaggatg

SEQ ID NO: 10054468 - DNA, 22 bp, Homo sapiens
ttgaaagaactcttcagagata

SEQ ID NO: 10054469 - DNA, 22 bp, Homo sapiens
ttgaccactgaatggttctgaa

SEQ ID NO: 10054470 - DNA, 19 bp, Homo sapiens
ttgagaaagttgatttggg

SEQ ID NO: 10054471 - DNA, 22 bp, Homo sapiens
ttctttggcatttcctgtatgt

SEQ ID NO: 10054472 - DNA, 22 bp, Homo sapiens
ttctttgggctcagagagggag

SEQ ID NO: 10054473 - DNA, 22 bp, Homo sapiens
ttctggagtcccacagccaggg

SEQ ID NO: 10054474 - DNA, 22 bp, Homo sapiens
ttcttcctctgtaaaaggtgac

SEQ ID NO: 10054475 - DNA, 22 bp, Homo sapiens
ttctaaacttcaattctaaatt

SEQ ID NO: 10054476 - DNA, 20 bp, Homo sapiens
ttctaaactgttaggcttgc

SEQ ID NO: 10054477 - DNA, 22 bp, Homo sapiens
ttctaaactgaagtattttaaa

SEQ ID NO: 10054478 - DNA, 22 bp, Homo sapiens
ttcgtttagtccacaaatgcat

SEQ ID NO: 10054479 - DNA, 22 bp, Homo sapiens
ttctccgctaagttctctgcag

SEQ ID NO: 10054480 - DNA, 22 bp, Homo sapiens
ttctcctcagcaaggcagcttt

SEQ ID NO: 10054481 - DNA, 17 bp, Homo sapiens
ttctcttcctggatagt

SEQ ID NO: 10054482 - DNA, 23 bp, Homo sapiens
ttctctttagatttacattactc

SEQ ID NO: 10054483 - DNA, 20 bp, Homo sapiens
ttctctttgggtccagagaa

SEQ ID NO: 10054484 - DNA, 22 bp, Homo sapiens
ttctgaggcactggctctccca

SEQ ID NO: 10054485 - DNA, 22 bp, Homo sapiens
ttctctttatgtatttagtggg

SEQ ID NO: 10054486 - DNA, 22 bp, Homo sapiens
ttctctttatgtatttagtggg

SEQ ID NO: 10054487 - DNA, 22 bp, Homo sapiens
ttctctttctacagtgtgattg

SEQ ID NO: 10054488 - DNA, 22 bp, Homo sapiens
ttctctttgacattattcaggt

SEQ ID NO: 10054489 - DNA, 22 bp, Homo sapiens
ttctctttctgctgggctggaa

SEQ ID NO: 10054490 - DNA, 22 bp, Homo sapiens
ttctgagtctcctgtcgacagt

SEQ ID NO: 10054491 - DNA, 22 bp, Homo sapiens
ttctgattgctgatgaggccca

SEQ ID NO: 10054492 - DNA, 22 bp, Homo sapiens
ttctgcattatacacaacctaa

SEQ ID NO: 10054493 - DNA, 20 bp, Homo sapiens
ttctggaggctacaagtctg

SEQ ID NO: 10054494 - DNA, 22 bp, Homo sapiens
tttcatctctctaaaagacagt

SEQ ID NO: 10054495 - DNA, 22 bp, Homo sapiens
tttcataatagtgcagtttgtt

SEQ ID NO: 10054496 - DNA, 22 bp, Homo sapiens
tttcacaactgcttatttgaga

SEQ ID NO: 10054497 - DNA, 22 bp, Homo sapiens
tttcagtttgaaggaaaggcca

SEQ ID NO: 10054498 - DNA, 22 bp, Homo sapiens
tttcataaacagtagaagacta

SEQ ID NO: 10054499 - DNA, 22 bp, Homo sapiens
tttagttattgcacagaattag

SEQ ID NO: 10054500 - DNA, 22 bp, Homo sapiens
tttatcttctgcagttctggct

SEQ ID NO: 10054501 - DNA, 22 bp, Homo sapiens
tttacacatacctctttaaagt

SEQ ID NO: 10054502 - DNA, 19 bp, Homo sapiens
tttacaagttctttgtatg

SEQ ID NO: 10054503 - DNA, 22 bp, Homo sapiens
tttaagatctatcccattttgt

SEQ ID NO: 10054504 - DNA, 22 bp, Homo sapiens
tttacaagtcagggactgttct

SEQ ID NO: 10054505 - DNA, 22 bp, Homo sapiens
tttacagatgaggatactgagg

SEQ ID NO: 10054506 - DNA, 22 bp, Homo sapiens
tttacagatgaggaaactgaga

SEQ ID NO: 10054507 - DNA, 22 bp, Homo sapiens
tttacagatgtggaaagtgagc

SEQ ID NO: 10054508 - DNA, 22 bp, Homo sapiens
tttacagaatgtcaatttctat

SEQ ID NO: 10054509 - DNA, 22 bp, Homo sapiens
tttacagagagagaactggact

SEQ ID NO: 10054510 - DNA, 22 bp, Homo sapiens
tttaaattatagttaatgtctg

SEQ ID NO: 10054511 - DNA, 22 bp, Homo sapiens
ttgttgtcattgtagaggattt

SEQ ID NO: 10054512 - DNA, 22 bp, Homo sapiens
ttgtattcttccttagcagtac

SEQ ID NO: 10054513 - DNA, 20 bp, Homo sapiens
ttgtattccttgaatcaggt

SEQ ID NO: 10054514 - DNA, 22 bp, Homo sapiens
ttgtatttcctataacctttct

SEQ ID NO: 10054515 - DNA, 22 bp, Homo sapiens
ttgtatttatattgaatagctt

SEQ ID NO: 10054516 - DNA, 22 bp, Homo sapiens
ttgtatatattcttaaagatgt

SEQ ID NO: 10054517 - DNA, 22 bp, Homo sapiens
ttgtatatattcttaaagatgt

SEQ ID NO: 10054518 - DNA, 22 bp, Homo sapiens
ttgtagcttatcaaggctgttt

SEQ ID NO: 10054519 - DNA, 22 bp, Homo sapiens
ttgtagctttttaatgtgctgc

SEQ ID NO: 10054520 - DNA, 22 bp, Homo sapiens
ttgtagctgaaagtaaagaagt

SEQ ID NO: 10054521 - DNA, 18 bp, Homo sapiens
ttggggtgaggccaggaa

SEQ ID NO: 10054522 - DNA, 22 bp, Homo sapiens
ttgtgctgtgagaatgctcatt

SEQ ID NO: 10054523 - DNA, 22 bp, Homo sapiens
ttgtgcttaagcaagctttctt

SEQ ID NO: 10054524 - DNA, 22 bp, Homo sapiens
ttgtgctttggaacagaatcct

SEQ ID NO: 10054525 - DNA, 22 bp, Homo sapiens
ttgtgctctgtgttatttaagg

SEQ ID NO: 10054526 - DNA, 22 bp, Homo sapiens
ttgtgctctgtgttatttaagg

SEQ ID NO: 10054527 - DNA, 22 bp, Homo sapiens
ttgtgcatgactgtgaatagct

SEQ ID NO: 10054528 - DNA, 22 bp, Homo sapiens
ttgtgcattagggaaaggaact

SEQ ID NO: 10054529 - DNA, 22 bp, Homo sapiens
ttgggctgaagtagagggcaga

SEQ ID NO: 10054530 - DNA, 22 bp, Homo sapiens
ttggggagttaatgccaaagat

SEQ ID NO: 10054531 - DNA, 22 bp, Homo sapiens
ttggggagaaatgaaatgaagt

SEQ ID NO: 10054532 - DNA, 22 bp, Homo sapiens
ttgggaaattactctgctagga

SEQ ID NO: 10054533 - DNA, 22 bp, Homo sapiens
ttgggaaatatggattgttatt

SEQ ID NO: 10054534 - DNA, 22 bp, Homo sapiens
ttggcttcttcgcacagcagta

SEQ ID NO: 10054535 - DNA, 22 bp, Homo sapiens
ttggcgcccaggacgccgccgc

SEQ ID NO: 10054536 - DNA, 21 bp, Homo sapiens
ttggccgtgcagatgaacagc

SEQ ID NO: 10054537 - DNA, 22 bp, Homo sapiens
ttggaagagtagagttgaataa

SEQ ID NO: 10054538 - DNA, 22 bp, Homo sapiens
ttggaagacagtgaaacagcac

SEQ ID NO: 10054539 - DNA, 22 bp, Homo sapiens
ttggaagagagccacagttaat

SEQ ID NO: 10054540 - DNA, 22 bp, Homo sapiens
ttgctttaaaatggctaagtct

SEQ ID NO: 10054541 - DNA, 22 bp, Homo sapiens
ttgctttaactagtaaatgggg

SEQ ID NO: 10054542 - DNA, 22 bp, Homo sapiens
ttgctttaaggtatctggagaa

SEQ ID NO: 10054543 - DNA, 22 bp, Homo sapiens
ttgctttaggatttaagtggca

SEQ ID NO: 10054544 - DNA, 22 bp, Homo sapiens
ttgctttacaaaaattgatggt

SEQ ID NO: 10054545 - DNA, 22 bp, Homo sapiens
ttgctttacatgttctggtaaa

SEQ ID NO: 10054546 - DNA, 22 bp, Homo sapiens
ttggaagacaatgctgattctc

SEQ ID NO: 10054547 - DNA, 22 bp, Homo sapiens
ttgctttattcacatctatatt

SEQ ID NO: 10054548 - DNA, 22 bp, Homo sapiens
ttgctttatgtgtatgacttga

SEQ ID NO: 10054549 - DNA, 22 bp, Homo sapiens
ttgctttatattcaagagagga

SEQ ID NO: 10054550 - DNA, 20 bp, Homo sapiens
ttgctttatcagacatgata

SEQ ID NO: 10054551 - DNA, 22 bp, Homo sapiens
ttgctcatactcatgttgtgat

SEQ ID NO: 10054552 - DNA, 22 bp, Homo sapiens
ttgctattttgagagtcatagt

SEQ ID NO: 10054553 - DNA, 22 bp, Homo sapiens
ttgcatttgctcatttgatatg

SEQ ID NO: 10054554 - DNA, 22 bp, Homo sapiens
ttgcatttgtttgagtagaatg

SEQ ID NO: 10054555 - DNA, 22 bp, Homo sapiens
ttgcatttttgagcacgaagtt

SEQ ID NO: 10054556 - DNA, 22 bp, Homo sapiens
ttgcatttcactttcagtaggc

SEQ ID NO: 10054557 - DNA, 22 bp, Homo sapiens
ttgcatttcccattgagtaatg

SEQ ID NO: 10054558 - DNA, 18 bp, Homo sapiens
cctcacagacttccatgt

SEQ ID NO: 10054559 - DNA, 21 bp, Homo sapiens
ccctgtgttccacagcagaca

SEQ ID NO: 10054560 - DNA, 23 bp, Homo sapiens
cccttcagcgagggcattaaggt

SEQ ID NO: 10054561 - DNA, 22 bp, Homo sapiens
cccttcagctgagtgggacagc

SEQ ID NO: 10054562 - DNA, 22 bp, Homo sapiens
cccttcagggttaagtagaggg

SEQ ID NO: 10054563 - DNA, 22 bp, Homo sapiens
cctcgcggcactcgggccggat

SEQ ID NO: 10054564 - DNA, 22 bp, Homo sapiens
cctctctccaattttcacctca

SEQ ID NO: 10054565 - DNA, 22 bp, Homo sapiens
agggcagctggaaggtggcttc

SEQ ID NO: 10054566 - DNA, 22 bp, Homo sapiens
agggcagcggtgcttgtgttat

SEQ ID NO: 10054567 - DNA, 22 bp, Homo sapiens
agggaggagtcctcaaagtcat

SEQ ID NO: 10054568 - DNA, 22 bp, Homo sapiens
agggaggagaatggactccttc

SEQ ID NO: 10054569 - DNA, 22 bp, Homo sapiens
agggaggaaggatgttccaaag

SEQ ID NO: 10054570 - DNA, 22 bp, Homo sapiens
agggaggaccaatgtgtggtta

SEQ ID NO: 10054571 - DNA, 22 bp, Homo sapiens
agggcagccattgagggattct

SEQ ID NO: 10054572 - DNA, 22 bp, Homo sapiens
ccccagcagactcagggcaggt

SEQ ID NO: 10054573 - DNA, 22 bp, Homo sapiens
ccccatcttccctgagggattt

SEQ ID NO: 10054574 - DNA, 22 bp, Homo sapiens
cccagcctgatctcggccagct

SEQ ID NO: 10054575 - DNA, 22 bp, Homo sapiens
cccagcctctgtttgctcctct

SEQ ID NO: 10054576 - DNA, 22 bp, Homo sapiens
aggctgtgtttcttgcgttttc

SEQ ID NO: 10054577 - DNA, 22 bp, Homo sapiens
aggctgtgtggtcatggtggct

SEQ ID NO: 10054578 - DNA, 22 bp, Homo sapiens
aggctgtgttctgccctctccc

SEQ ID NO: 10054579 - DNA, 22 bp, Homo sapiens
cccagctctgccatctacccac

SEQ ID NO: 10054580 - DNA, 22 bp, Homo sapiens
cccagcactcagcaggctcata

SEQ ID NO: 10054581 - DNA, 22 bp, Homo sapiens
cccagcagtaaccagtggaaat

SEQ ID NO: 10054582 - DNA, 22 bp, Homo sapiens
cccagcagtagagctcatatgg

SEQ ID NO: 10054583 - DNA, 22 bp, Homo sapiens
cccagcagtttgcttagagtga

SEQ ID NO: 10054584 - DNA, 22 bp, Homo sapiens
cccagcagttgttggtgcacat

SEQ ID NO: 10054585 - DNA, 22 bp, Homo sapiens
aggccagatgtcgggctagaag

SEQ ID NO: 10054586 - DNA, 20 bp, Homo sapiens
aggccaggaaatgtagttct

SEQ ID NO: 10054587 - DNA, 22 bp, Homo sapiens
aggcagcctggtttgaatggaa

SEQ ID NO: 10054588 - DNA, 22 bp, Homo sapiens
aggcagtggagctggaataggc

SEQ ID NO: 10054589 - DNA, 22 bp, Homo sapiens
ccactgggcgtttctgtccaat

SEQ ID NO: 10054590 - DNA, 22 bp, Homo sapiens
ccactggagactggtctctgtg

SEQ ID NO: 10054591 - DNA, 22 bp, Homo sapiens
aggctccattttcctgcagctg

SEQ ID NO: 10054592 - DNA, 22 bp, Homo sapiens
aggctccattccaggagctaga

SEQ ID NO: 10054593 - DNA, 22 bp, Homo sapiens
aggctccattttcctgcagctg

SEQ ID NO: 10054594 - DNA, 22 bp, Homo sapiens
aggctccatgcaaaggctgttt

SEQ ID NO: 10054595 - DNA, 22 bp, Homo sapiens
aggctccataccatctccggag

SEQ ID NO: 10054596 - DNA, 22 bp, Homo sapiens
aggctccataccatctccggag

SEQ ID NO: 10054597 - DNA, 22 bp, Homo sapiens
aggctccattcatgtgaaggca

SEQ ID NO: 10054598 - DNA, 22 bp, Homo sapiens
aggctccatggttctccctcag

SEQ ID NO: 10054599 - DNA, 22 bp, Homo sapiens
aggctccatgctaagcgatatg

SEQ ID NO: 10054600 - DNA, 22 bp, Homo sapiens
aggctccacggcaggatgctgt

SEQ ID NO: 10054601 - DNA, 22 bp, Homo sapiens
aggctccagtctgaaccttggg

SEQ ID NO: 10054602 - DNA, 22 bp, Homo sapiens
aggctccacggtcactggctct

SEQ ID NO: 10054603 - DNA, 22 bp, Homo sapiens
aggcctcaggaaggtaaagaag

SEQ ID NO: 10054604 - DNA, 22 bp, Homo sapiens
ccagtctgtgtgccagcctgcg

SEQ ID NO: 10054605 - DNA, 22 bp, Homo sapiens
ccagttctaaacataaagctaa

SEQ ID NO: 10054606 - DNA, 22 bp, Homo sapiens
ccagtttaagacttatctcaat

SEQ ID NO: 10054607 - DNA, 22 bp, Homo sapiens
aggctctgcagtccatcccgtg

SEQ ID NO: 10054608 - DNA, 22 bp, Homo sapiens
aggctctgatgcaagcccaggg

SEQ ID NO: 10054609 - DNA, 22 bp, Homo sapiens
aggctctgcagaccccagctgt

SEQ ID NO: 10054610 - DNA, 22 bp, Homo sapiens
aggctctgagtagagctgccag

SEQ ID NO: 10054611 - DNA, 22 bp, Homo sapiens
aggctctgatcaggtggctgtg

SEQ ID NO: 10054612 - DNA, 22 bp, Homo sapiens
aggctctgccaattccttcctc

SEQ ID NO: 10054613 - DNA, 20 bp, Homo sapiens
aggctctgccattgtccctg

SEQ ID NO: 10054614 - DNA, 22 bp, Homo sapiens
agctgtgtcctgaagacactgc

SEQ ID NO: 10054615 - DNA, 22 bp, Homo sapiens
caggcctggctgcagctcgcct

SEQ ID NO: 10054616 - DNA, 22 bp, Homo sapiens
agctggcttttgtgaaggtttt

SEQ ID NO: 10054617 - DNA, 22 bp, Homo sapiens
agctgttccctcactgcagtca

SEQ ID NO: 10054618 - DNA, 22 bp, Homo sapiens
agctgttgctgggaggagagaa

SEQ ID NO: 10054619 - DNA, 22 bp, Homo sapiens
agctgttggagtaaagcactta

SEQ ID NO: 10054620 - DNA, 22 bp, Homo sapiens
agctgttgtctgcaggagaagc

SEQ ID NO: 10054621 - DNA, 22 bp, Homo sapiens
agctgttccaggcctcattgct

SEQ ID NO: 10054622 - DNA, 22 bp, Homo sapiens
aggaaataggaccagacaaagc

SEQ ID NO: 10054623 - DNA, 22 bp, Homo sapiens
aggaaatgccgcggctctcttt

SEQ ID NO: 10054624 - DNA, 21 bp, Homo sapiens
aggaaaggaagtccccagggt

SEQ ID NO: 10054625 - DNA, 22 bp, Homo sapiens
aggaaagcttggcaaactaaat

SEQ ID NO: 10054626 - DNA, 22 bp, Homo sapiens
agctttaaaaatccaatatcca

SEQ ID NO: 10054627 - DNA, 21 bp, Homo sapiens
agctgcagtcaagccagaggt

SEQ ID NO: 10054628 - DNA, 22 bp, Homo sapiens
agctgaggcatgatgctatcag

SEQ ID NO: 10054629 - DNA, 22 bp, Homo sapiens
caggaggtgacttccaggggtt

SEQ ID NO: 10054630 - DNA, 22 bp, Homo sapiens
agctggcattgcagggagctgc

SEQ ID NO: 10054631 - DNA, 22 bp, Homo sapiens
agctggctgccttctccttagg

SEQ ID NO: 10054632 - DNA, 22 bp, Homo sapiens
agctggctggccccttcctgcc

SEQ ID NO: 10054633 - DNA, 22 bp, Homo sapiens
agctggcttcacaggcagtgtg

SEQ ID NO: 10054634 - DNA, 22 bp, Homo sapiens
agctggctgggtgccagtctcc

SEQ ID NO: 10054635 - DNA, 22 bp, Homo sapiens
agctggcttctctgcagacatt

SEQ ID NO: 10054636 - DNA, 22 bp, Homo sapiens
agctggcttctctgcagacatt

SEQ ID NO: 10054637 - DNA, 22 bp, Homo sapiens
agctggctttatggttggctaa

SEQ ID NO: 10054638 - DNA, 22 bp, Homo sapiens
agctggcttgcatgctaaggag

SEQ ID NO: 10054639 - DNA, 22 bp, Homo sapiens
agctggctttgagctgggaggt

SEQ ID NO: 10054640 - DNA, 22 bp, Homo sapiens
caggacagagcccagactgtgt

SEQ ID NO: 10054641 - DNA, 19 bp, Homo sapiens
caggacagacttcaaagcc

SEQ ID NO: 10054642 - DNA, 22 bp, Homo sapiens
agctgcctggagtcatttcctg

SEQ ID NO: 10054643 - DNA, 22 bp, Homo sapiens
caggaaaaatgccaggagtcag

SEQ ID NO: 10054644 - DNA, 22 bp, Homo sapiens
agctgctgagagtctgccgggc

SEQ ID NO: 10054645 - DNA, 22 bp, Homo sapiens
agctgctgaatgacactgcaag

SEQ ID NO: 10054646 - DNA, 22 bp, Homo sapiens
catgcagagtttattaccatct

SEQ ID NO: 10054647 - DNA, 22 bp, Homo sapiens
aggcaatgcagatagatgaatg

SEQ ID NO: 10054648 - DNA, 22 bp, Homo sapiens
aggcacagcctcccttcacatg

SEQ ID NO: 10054649 - DNA, 22 bp, Homo sapiens
aggcacagcctcccttcacatg

SEQ ID NO: 10054650 - DNA, 22 bp, Homo sapiens
aggcacaggaatgtcatccagt

SEQ ID NO: 10054651 - DNA, 22 bp, Homo sapiens
aggcacaggaatgtcatccagt

SEQ ID NO: 10054652 - DNA, 22 bp, Homo sapiens
catgaaaataacattgttgtga

SEQ ID NO: 10054653 - DNA, 22 bp, Homo sapiens
catgaaaatgtcaagttctgct

SEQ ID NO: 10054654 - DNA, 22 bp, Homo sapiens
catctttaaaatgggaacaaca

SEQ ID NO: 10054655 - DNA, 22 bp, Homo sapiens
catgaaaatgtcaagttctgct

SEQ ID NO: 10054656 - DNA, 22 bp, Homo sapiens
aggaggtgcgtggtgatcccct

SEQ ID NO: 10054657 - DNA, 22 bp, Homo sapiens
catgaaatctgagtatgtttcc

SEQ ID NO: 10054658 - DNA, 22 bp, Homo sapiens
cattcccatgactcctgctcag

SEQ ID NO: 10054659 - DNA, 21 bp, Homo sapiens
cattcctcggctcatagagga

SEQ ID NO: 10054660 - DNA, 22 bp, Homo sapiens
catggcggtcaggatgtaggtg

SEQ ID NO: 10054661 - DNA, 21 bp, Homo sapiens
catttacatgacagattggtt

SEQ ID NO: 10054662 - DNA, 22 bp, Homo sapiens
catttacataacagtaacgctg

SEQ ID NO: 10054663 - DNA, 22 bp, Homo sapiens
catttacagtgagagtttttac

SEQ ID NO: 10054664 - DNA, 22 bp, Homo sapiens
aggcagcagcttgctggttgcc

SEQ ID NO: 10054665 - DNA, 22 bp, Homo sapiens
aggcagcatttctgcttatcca

SEQ ID NO: 10054666 - DNA, 19 bp, Homo sapiens
aggcagcattctggggctt

SEQ ID NO: 10054667 - DNA, 22 bp, Homo sapiens
catttacatttaaggttaatat

SEQ ID NO: 10054668 - DNA, 22 bp, Homo sapiens
cagtctctttatccaccaagcc

SEQ ID NO: 10054669 - DNA, 22 bp, Homo sapiens
cagtctctcttgtagtgcagct

SEQ ID NO: 10054670 - DNA, 22 bp, Homo sapiens
aggactttagagccagaaagac

SEQ ID NO: 10054671 - DNA, 22 bp, Homo sapiens
cagtccagtgatttttccagtt

SEQ ID NO: 10054672 - DNA, 18 bp, Homo sapiens
aggagcctttgcactgga

SEQ ID NO: 10054673 - DNA, 22 bp, Homo sapiens
aggagctgataaaagggggtca

SEQ ID NO: 10054674 - DNA, 20 bp, Homo sapiens
aggagctgaattagagggtt

SEQ ID NO: 10054675 - DNA, 22 bp, Homo sapiens
aggaggaggtaagaaaagcata

SEQ ID NO: 10054676 - DNA, 22 bp, Homo sapiens
aggaggaggtaagaaaagcata

SEQ ID NO: 10054677 - DNA, 22 bp, Homo sapiens
aggaggaatacaatccagcagc

SEQ ID NO: 10054678 - DNA, 22 bp, Homo sapiens
agtgctggcccatagctgctgg

SEQ ID NO: 10054679 - DNA, 22 bp, Homo sapiens
ctcgggcttgaggctgtttacc

SEQ ID NO: 10054680 - DNA, 22 bp, Homo sapiens
ctcggcaggtggaggttgtagt

SEQ ID NO: 10054681 - DNA, 22 bp, Homo sapiens
agtgctgggctatctactgcta

SEQ ID NO: 10054682 - DNA, 22 bp, Homo sapiens
ctctccaagttatcaagatgaa

SEQ ID NO: 10054683 - DNA, 23 bp, Homo sapiens
ctctccaccttcccacccaggga

SEQ ID NO: 10054684 - DNA, 22 bp, Homo sapiens
ctcgcatgccctgcctcatcca

SEQ ID NO: 10054685 - DNA, 22 bp, Homo sapiens
agtgctataaaggtagaccaca

SEQ ID NO: 10054686 - DNA, 22 bp, Homo sapiens
agtgctgactctgggcacagtg

SEQ ID NO: 10054687 - DNA, 22 bp, Homo sapiens
agtggtggagagatgaggacac

SEQ ID NO: 10054688 - DNA, 22 bp, Homo sapiens
agtggtgccattaaaatcattg

SEQ ID NO: 10054689 - DNA, 22 bp, Homo sapiens
agtggtgaggggcatgtgtgat

SEQ ID NO: 10054690 - DNA, 22 bp, Homo sapiens
agtggtgctaggtggaatatag

SEQ ID NO: 10054691 - DNA, 22 bp, Homo sapiens
ctcttagtaatgccatgaagca

SEQ ID NO: 10054692 - DNA, 22 bp, Homo sapiens
ctctgtatagaaaggaaacatt

SEQ ID NO: 10054693 - DNA, 22 bp, Homo sapiens
ctctgtatgaatcatatggagt

SEQ ID NO: 10054694 - DNA, 22 bp, Homo sapiens
ctctggagaactccttgtgtct

SEQ ID NO: 10054695 - DNA, 23 bp, Homo sapiens
ctctggagatcctctgcctgggt

SEQ ID NO: 10054696 - DNA, 22 bp, Homo sapiens
ctcagccccagcccagatagca

SEQ ID NO: 10054697 - DNA, 22 bp, Homo sapiens
ctcagtgtgagtgagaagtgca

SEQ ID NO: 10054698 - DNA, 22 bp, Homo sapiens
ctcagtgtcttattgtacacat

SEQ ID NO: 10054699 - DNA, 22 bp, Homo sapiens
ctccagaaatttggatgcagca

SEQ ID NO: 10054700 - DNA, 18 bp, Homo sapiens
ctcagacatgcttctttt

SEQ ID NO: 10054701 - DNA, 22 bp, Homo sapiens
ctcagaagttcagcctagagta

SEQ ID NO: 10054702 - DNA, 22 bp, Homo sapiens
ctcagaagaatcagcagctatt

SEQ ID NO: 10054703 - DNA, 22 bp, Homo sapiens
ctcagaagaacccagggtccca

SEQ ID NO: 10054704 - DNA, 22 bp, Homo sapiens
ctcagaagaacaaaggctctac

SEQ ID NO: 10054705 - DNA, 22 bp, Homo sapiens
ctcagaaagtgacaggggggtg

SEQ ID NO: 10054706 - DNA, 22 bp, Homo sapiens
ctcagaaatcccactctgtgta

SEQ ID NO: 10054707 - DNA, 22 bp, Homo sapiens
cggggttcatccatgctgtggc

SEQ ID NO: 10054708 - DNA, 22 bp, Homo sapiens
agtatgaacggaaggcctggga

SEQ ID NO: 10054709 - DNA, 22 bp, Homo sapiens
cggggtccctgcccacccatac

SEQ ID NO: 10054710 - DNA, 22 bp, Homo sapiens
agtcccaacagcttacaaggaa

SEQ ID NO: 10054711 - DNA, 23 bp, Homo sapiens
ctcaaccctagtaagggagtagg

SEQ ID NO: 10054712 - DNA, 22 bp, Homo sapiens
cggaggggtttgaacagaggag

SEQ ID NO: 10054713 - DNA, 21 bp, Homo sapiens
cggagctgggcagggcatccc

SEQ ID NO: 10054714 - DNA, 22 bp, Homo sapiens
cggagctgcgccgggacacggg

SEQ ID NO: 10054715 - DNA, 22 bp, Homo sapiens
cggagctggcgtctgtgtggac

SEQ ID NO: 10054716 - DNA, 22 bp, Homo sapiens
cggagctgcctgccaagcctgc

SEQ ID NO: 10054717 - DNA, 22 bp, Homo sapiens
cggccgcagcagtgtcggccca

SEQ ID NO: 10054718 - DNA, 22 bp, Homo sapiens
aggtggggtgagctgcagacta

SEQ ID NO: 10054719 - DNA, 22 bp, Homo sapiens
aggtgggggctgtgtccttgac

SEQ ID NO: 10054720 - DNA, 22 bp, Homo sapiens
aggtgggggctgtgtccttgac

SEQ ID NO: 10054721 - DNA, 22 bp, Homo sapiens
cctttattcaattagtcctaat

SEQ ID NO: 10054722 - DNA, 22 bp, Homo sapiens
aggtggggtgttggatgtttat

SEQ ID NO: 10054723 - DNA, 19 bp, Homo sapiens
cctttggtttttggttcat

SEQ ID NO: 10054724 - DNA, 19 bp, Homo sapiens
cctttggtttccatgacat

SEQ ID NO: 10054725 - DNA, 22 bp, Homo sapiens
cctttggtcacctccactctta

SEQ ID NO: 10054726 - DNA, 22 bp, Homo sapiens
cctttggtggcttcaaaatggc

SEQ ID NO: 10054727 - DNA, 22 bp, Homo sapiens
cctttggtcttgatgaactgtt

SEQ ID NO: 10054728 - DNA, 22 bp, Homo sapiens
cctttggtggttttcagagatc

SEQ ID NO: 10054729 - DNA, 22 bp, Homo sapiens
cctttggttgagtgaaagtaag

SEQ ID NO: 10054730 - DNA, 22 bp, Homo sapiens
cctttggtgttattgggagaca

SEQ ID NO: 10054731 - DNA, 22 bp, Homo sapiens
aggtggcagttgtggaaccatc

SEQ ID NO: 10054732 - DNA, 22 bp, Homo sapiens
aggtggcatgagactgtaccag

SEQ ID NO: 10054733 - DNA, 17 bp, Homo sapiens
aggtgctggagcatcag

SEQ ID NO: 10054734 - DNA, 22 bp, Homo sapiens
aggtggggctgggaaagattcc

SEQ ID NO: 10054735 - DNA, 22 bp, Homo sapiens
aggtggctgcctccccgcgcgg

SEQ ID NO: 10054736 - DNA, 22 bp, Homo sapiens
aggtggcttctggccaggtgtg

SEQ ID NO: 10054737 - DNA, 22 bp, Homo sapiens
cctgcctggcttccagaagaga

SEQ ID NO: 10054738 - DNA, 22 bp, Homo sapiens
cctgctctccatacactttcta

SEQ ID NO: 10054739 - DNA, 19 bp, Homo sapiens
cctgctgcaccacttgtta

SEQ ID NO: 10054740 - DNA, 19 bp, Homo sapiens
cctgctgcaccacttgtta

SEQ ID NO: 10054741 - DNA, 20 bp, Homo sapiens
agggtctgatgtggtggccc

SEQ ID NO: 10054742 - DNA, 22 bp, Homo sapiens
agggtctgtggatgcatctggg

SEQ ID NO: 10054743 - DNA, 22 bp, Homo sapiens
agggtctttcctgggagccagc

SEQ ID NO: 10054744 - DNA, 22 bp, Homo sapiens
agggtgaatctcacaactctta

SEQ ID NO: 10054745 - DNA, 20 bp, Homo sapiens
agggtcagtagcacagagct

SEQ ID NO: 10054746 - DNA, 20 bp, Homo sapiens
agggtcagagagcgtgagtg

SEQ ID NO: 10054747 - DNA, 21 bp, Homo sapiens
agggtcaggaaccagggtacc

SEQ ID NO: 10054748 - DNA, 22 bp, Homo sapiens
cctctctctcctgcacacacac

SEQ ID NO: 10054749 - DNA, 22 bp, Homo sapiens
cctctctccaattttcacctca

SEQ ID NO: 10054750 - DNA, 22 bp, Homo sapiens
cctctctccttcctttgccaaa

SEQ ID NO: 10054751 - DNA, 22 bp, Homo sapiens
cctctgccacctcccacgaggc

SEQ ID NO: 10054752 - DNA, 22 bp, Homo sapiens
cctgcccagggtcaccacagag

SEQ ID NO: 10054753 - DNA, 22 bp, Homo sapiens
cctgcccctcaaggcctggtgc

SEQ ID NO: 10054754 - DNA, 22 bp, Homo sapiens
atatgttactctttcaagcaga

SEQ ID NO: 10054755 - DNA, 22 bp, Homo sapiens
atatataatacttgctgtgggc

SEQ ID NO: 10054756 - DNA, 22 bp, Homo sapiens
atatataagctgatgagccaca

SEQ ID NO: 10054757 - DNA, 22 bp, Homo sapiens
atatataacctggataaggctt

SEQ ID NO: 10054758 - DNA, 22 bp, Homo sapiens
atataactctccattaagggcc

SEQ ID NO: 10054759 - DNA, 22 bp, Homo sapiens
atataactcttgttcttatagt

SEQ ID NO: 10054760 - DNA, 19 bp, Homo sapiens
ctgggacaatgaaagcatc

SEQ ID NO: 10054761 - DNA, 22 bp, Homo sapiens
atataacatacatacagaaaag

SEQ ID NO: 10054762 - DNA, 22 bp, Homo sapiens
atataacatacatacagaaaag

SEQ ID NO: 10054763 - DNA, 22 bp, Homo sapiens
ctgggaatgagcaggtggctcc

SEQ ID NO: 10054764 - DNA, 22 bp, Homo sapiens
ctggcagctgtgtgaagaactg

SEQ ID NO: 10054765 - DNA, 22 bp, Homo sapiens
ctgggactttgtaggccagttg

SEQ ID NO: 10054766 - DNA, 22 bp, Homo sapiens
ctgggagagcctttcctgagtc

SEQ ID NO: 10054767 - DNA, 22 bp, Homo sapiens
ctgggcacagtggctcacgcct

SEQ ID NO: 10054768 - DNA, 22 bp, Homo sapiens
ctgggcacagcgttgggctctt

SEQ ID NO: 10054769 - DNA, 22 bp, Homo sapiens
ctgggtctaaaaattctcagat

SEQ ID NO: 10054770 - DNA, 22 bp, Homo sapiens
atcacattatgtagtgaaaagg

SEQ ID NO: 10054771 - DNA, 22 bp, Homo sapiens
ctgtcttttcatactttccctc

SEQ ID NO: 10054772 - DNA, 22 bp, Homo sapiens
ctgtcttttcttctcattgatg

SEQ ID NO: 10054773 - DNA, 22 bp, Homo sapiens
ctgtcttttactatcatttact

SEQ ID NO: 10054774 - DNA, 18 bp, Homo sapiens
ctgtcttttttctctcca

SEQ ID NO: 10054775 - DNA, 22 bp, Homo sapiens
ctgtgatatactcccaagagga

SEQ ID NO: 10054776 - DNA, 22 bp, Homo sapiens
ctgtgataggtcatactgtctc

SEQ ID NO: 10054777 - DNA, 22 bp, Homo sapiens
atccaaactatgactagtgttc

SEQ ID NO: 10054778 - DNA, 22 bp, Homo sapiens
atccaaacctggacatgagtgg

SEQ ID NO: 10054779 - DNA, 22 bp, Homo sapiens
atccaaagatggaaagaacttt

SEQ ID NO: 10054780 - DNA, 22 bp, Homo sapiens
atccaaaggtgacacagaatac

SEQ ID NO: 10054781 - DNA, 22 bp, Homo sapiens
atccaatggggagtgagttctt

SEQ ID NO: 10054782 - DNA, 22 bp, Homo sapiens
atccaaaatttactgtagcatt

SEQ ID NO: 10054783 - DNA, 22 bp, Homo sapiens
ctgtggagcttgtggcagtggg

SEQ ID NO: 10054784 - DNA, 22 bp, Homo sapiens
atcctagaatcagcccttgctg

SEQ ID NO: 10054785 - DNA, 22 bp, Homo sapiens
atccccctgtatctggaagaat

SEQ ID NO: 10054786 - DNA, 20 bp, Homo sapiens
ctgcttgggacactgccaga

SEQ ID NO: 10054787 - DNA, 22 bp, Homo sapiens
ataatcaaagtcctatgacatc

SEQ ID NO: 10054788 - DNA, 22 bp, Homo sapiens
ataatatcgctcctttttttga

SEQ ID NO: 10054789 - DNA, 18 bp, Homo sapiens
atacaagatcaagtgttc

SEQ ID NO: 10054790 - DNA, 22 bp, Homo sapiens
atacaagacagtaggaaactga

SEQ ID NO: 10054791 - DNA, 22 bp, Homo sapiens
ctgctttaatttagacaaggca

SEQ ID NO: 10054792 - DNA, 22 bp, Homo sapiens
ctgctttaatgtaagatatacc

SEQ ID NO: 10054793 - DNA, 22 bp, Homo sapiens
ctgctttaatccctgcctggaa

SEQ ID NO: 10054794 - DNA, 22 bp, Homo sapiens
ctgctttaaaactgatacatga

SEQ ID NO: 10054795 - DNA, 22 bp, Homo sapiens
ctgctttaacagatgatggtgt

SEQ ID NO: 10054796 - DNA, 22 bp, Homo sapiens
ctgctttaagtattcaacaaag

SEQ ID NO: 10054797 - DNA, 22 bp, Homo sapiens
ctgctttaactctgggaagcca

SEQ ID NO: 10054798 - DNA, 22 bp, Homo sapiens
ataatacatggttgatcttttc

SEQ ID NO: 10054799 - DNA, 22 bp, Homo sapiens
ctgctctggctgtgtacttcag

SEQ ID NO: 10054800 - DNA, 22 bp, Homo sapiens
ctgctctgcaaggcacagtgat

SEQ ID NO: 10054801 - DNA, 22 bp, Homo sapiens
ctgctcagtaatagtcctatct

SEQ ID NO: 10054802 - DNA, 22 bp, Homo sapiens
ctgcccacagttctctgccatg

SEQ ID NO: 10054803 - DNA, 22 bp, Homo sapiens
atactctttatgacattccagc

SEQ ID NO: 10054804 - DNA, 22 bp, Homo sapiens
ctggagtgaagcttatttttca

SEQ ID NO: 10054805 - DNA, 22 bp, Homo sapiens
ctggagggctgcagcgaggctg

SEQ ID NO: 10054806 - DNA, 18 bp, Homo sapiens
atacagagacctcaagga

SEQ ID NO: 10054807 - DNA, 22 bp, Homo sapiens
atacagagacacttgagactgg

SEQ ID NO: 10054808 - DNA, 22 bp, Homo sapiens
atacagagcagtaatagaggag

SEQ ID NO: 10054809 - DNA, 22 bp, Homo sapiens
atacagagaaggggtagaggat

SEQ ID NO: 10054810 - DNA, 22 bp, Homo sapiens
ctggaggaaaacaactgcagac

SEQ ID NO: 10054811 - DNA, 22 bp, Homo sapiens
ctggagcatccatgcccagggt

SEQ ID NO: 10054812 - DNA, 22 bp, Homo sapiens
agtttaaatcatgttttgtaac

SEQ ID NO: 10054813 - DNA, 22 bp, Homo sapiens
agtttgtaaaatgtggcctgga

SEQ ID NO: 10054814 - DNA, 22 bp, Homo sapiens
agtttgaaagcttaacagtaca

SEQ ID NO: 10054815 - DNA, 22 bp, Homo sapiens
agtttgaattgaaatgcagatg

SEQ ID NO: 10054816 - DNA, 22 bp, Homo sapiens
agtttgaaggagttgaatcacc

SEQ ID NO: 10054817 - DNA, 22 bp, Homo sapiens
agtttgaagcacatgaatggca

SEQ ID NO: 10054818 - DNA, 22 bp, Homo sapiens
agtttgaagaaggtgagatgca

SEQ ID NO: 10054819 - DNA, 22 bp, Homo sapiens
agtttgaaagtattgacagaag

SEQ ID NO: 10054820 - DNA, 18 bp, Homo sapiens
agtttgaacaaggaagaa

SEQ ID NO: 10054821 - DNA, 20 bp, Homo sapiens
ataaaataactgccacaaga

SEQ ID NO: 10054822 - DNA, 22 bp, Homo sapiens
ataaaagtaggaccaacttaca

SEQ ID NO: 10054823 - DNA, 22 bp, Homo sapiens
ctgccaggcactgggctctgca

SEQ ID NO: 10054824 - DNA, 22 bp, Homo sapiens
ctgaggggtatccaaggggtaa

SEQ ID NO: 10054825 - DNA, 22 bp, Homo sapiens
agttgtatctgaatgcatgtag

SEQ ID NO: 10054826 - DNA, 22 bp, Homo sapiens
agttgtatacacttaggcagat

SEQ ID NO: 10054827 - DNA, 22 bp, Homo sapiens
ctgagggtgctattcttgcctt

SEQ ID NO: 10054828 - DNA, 22 bp, Homo sapiens
agttgggtttgtgtcagttgca

SEQ ID NO: 10054829 - DNA, 22 bp, Homo sapiens
gtatcctcacctatacaatgga

SEQ ID NO: 10054830 - DNA, 22 bp, Homo sapiens
gtatctttatccctcgttggag

SEQ ID NO: 10054831 - DNA, 22 bp, Homo sapiens
cagcagcactctgcgggtcccc

SEQ ID NO: 10054832 - DNA, 22 bp, Homo sapiens
cagcagcacctattatagtgtt

SEQ ID NO: 10054833 - DNA, 22 bp, Homo sapiens
cagcagcactctgcgggtcccc

SEQ ID NO: 10054834 - DNA, 22 bp, Homo sapiens
cagcagcagattcagcgtctgg

SEQ ID NO: 10054835 - DNA, 22 bp, Homo sapiens
cagcagcagagatactggtttc

SEQ ID NO: 10054836 - DNA, 22 bp, Homo sapiens
cagcagcagacatttgatcttc

SEQ ID NO: 10054837 - DNA, 22 bp, Homo sapiens
cagcagagtaggtgctacttct

SEQ ID NO: 10054838 - DNA, 22 bp, Homo sapiens
cagcagcaacaacggaagcctt

SEQ ID NO: 10054839 - DNA, 22 bp, Homo sapiens
cagcagcaacaacggaagcctt

SEQ ID NO: 10054840 - DNA, 22 bp, Homo sapiens
cagcagcaacaatagcggtcac

SEQ ID NO: 10054841 - DNA, 22 bp, Homo sapiens
cagcagcaaggtgagggtggag

SEQ ID NO: 10054842 - DNA, 22 bp, Homo sapiens
cagcagcaaatctagaagagga

SEQ ID NO: 10054843 - DNA, 22 bp, Homo sapiens
cagcagcaaatctagaagagga

SEQ ID NO: 10054844 - DNA, 22 bp, Homo sapiens
gtatctttccacatcttcagta

SEQ ID NO: 10054845 - DNA, 22 bp, Homo sapiens
gtatgaaaattgtaaagttctt

SEQ ID NO: 10054846 - DNA, 22 bp, Homo sapiens
cagcagcctccactcgccccac

SEQ ID NO: 10054847 - DNA, 22 bp, Homo sapiens
cagcagcctcttgtgcctgtgg

SEQ ID NO: 10054848 - DNA, 22 bp, Homo sapiens
cagcagcctccactcgccccac

SEQ ID NO: 10054849 - DNA, 22 bp, Homo sapiens
cagcagcctgccttgggagctt

SEQ ID NO: 10054850 - DNA, 22 bp, Homo sapiens
ggtggggctgcaagcagttcgg

SEQ ID NO: 10054851 - DNA, 22 bp, Homo sapiens
ggtggggctcagcaatctgtgt

SEQ ID NO: 10054852 - DNA, 22 bp, Homo sapiens
ggtggggtcacgacagagggaa

SEQ ID NO: 10054853 - DNA, 22 bp, Homo sapiens
ggtggggctaggacctcaggat

SEQ ID NO: 10054854 - DNA, 22 bp, Homo sapiens
ggttcccggatctccgagtccc

SEQ ID NO: 10054855 - DNA, 22 bp, Homo sapiens
ggttctgagaaactctcaccat

SEQ ID NO: 10054856 - DNA, 23 bp, Homo sapiens
ggttctgccgcttactgctgtgc

SEQ ID NO: 10054857 - DNA, 22 bp, Homo sapiens
gtaaaatctttcctatttgcct

SEQ ID NO: 10054858 - DNA, 22 bp, Homo sapiens
gtaaaatctttattgctggtga

SEQ ID NO: 10054859 - DNA, 22 bp, Homo sapiens
ggttctgctactctcttgctta

SEQ ID NO: 10054860 - DNA, 22 bp, Homo sapiens
ggttggacactaggtaggagcg

SEQ ID NO: 10054861 - DNA, 22 bp, Homo sapiens
gtaaaatcatttagttacttaa

SEQ ID NO: 10054862 - DNA, 22 bp, Homo sapiens
cagcattctactttgtgaactg

SEQ ID NO: 10054863 - DNA, 22 bp, Homo sapiens
cagcatttaatgcagtgcttcc

SEQ ID NO: 10054864 - DNA, 22 bp, Homo sapiens
cagcatttggtgatcatcttaa

SEQ ID NO: 10054865 - DNA, 22 bp, Homo sapiens
gtatttgtagtagcatagaatt

SEQ ID NO: 10054866 - DNA, 22 bp, Homo sapiens
gtatttgcaaatctaaaagaga

SEQ ID NO: 10054867 - DNA, 22 bp, Homo sapiens
cactggcctaagcgcctcagcc

SEQ ID NO: 10054868 - DNA, 22 bp, Homo sapiens
cagaagggacagggtttgtaga

SEQ ID NO: 10054869 - DNA, 22 bp, Homo sapiens
gggagcagttaaaatgattcct

SEQ ID NO: 10054870 - DNA, 22 bp, Homo sapiens
gggaggggttgcatgtttgagt

SEQ ID NO: 10054871 - DNA, 22 bp, Homo sapiens
cagacagggacctcgctccaga

SEQ ID NO: 10054872 - DNA, 22 bp, Homo sapiens
gggactgtgaggcctaactggg

SEQ ID NO: 10054873 - DNA, 22 bp, Homo sapiens
gggacttaatgcagagagggac

SEQ ID NO: 10054874 - DNA, 22 bp, Homo sapiens
cagaagtgaatgtgataaacca

SEQ ID NO: 10054875 - DNA, 22 bp, Homo sapiens
cagaagtgaatgtgataaacca

SEQ ID NO: 10054876 - DNA, 22 bp, Homo sapiens
gggactgtaaattcatatggcc

SEQ ID NO: 10054877 - DNA, 22 bp, Homo sapiens
gggactgtcctacatggagagg

SEQ ID NO: 10054878 - DNA, 22 bp, Homo sapiens
gggactgtcctctgtgtctgtg

SEQ ID NO: 10054879 - DNA, 22 bp, Homo sapiens
gggactgtccggcagaaggtac

SEQ ID NO: 10054880 - DNA, 20 bp, Homo sapiens
gggactgtcccatcctcatc

SEQ ID NO: 10054881 - DNA, 22 bp, Homo sapiens
gggagcaggacataatagcaat

SEQ ID NO: 10054882 - DNA, 22 bp, Homo sapiens
gggcactgtgctgggtgcttta

SEQ ID NO: 10054883 - DNA, 22 bp, Homo sapiens
gggcactgtgttcagagtgcag

SEQ ID NO: 10054884 - DNA, 22 bp, Homo sapiens
gggcactttgtgcctcactgtg

SEQ ID NO: 10054885 - DNA, 22 bp, Homo sapiens
cagagctgacccaaggattgaa

SEQ ID NO: 10054886 - DNA, 22 bp, Homo sapiens
cagagctctgacagctacagcc

SEQ ID NO: 10054887 - DNA, 21 bp, Homo sapiens
cagagctctttctgcttgctg

SEQ ID NO: 10054888 - DNA, 21 bp, Homo sapiens
cagagctgaagggtgtagtgt

SEQ ID NO: 10054889 - DNA, 22 bp, Homo sapiens
cagagctgattggatccagaga

SEQ ID NO: 10054890 - DNA, 22 bp, Homo sapiens
cagagctgcaaatgcccctccg

SEQ ID NO: 10054891 - DNA, 22 bp, Homo sapiens
cagagctgcacattctatgatg

SEQ ID NO: 10054892 - DNA, 22 bp, Homo sapiens
cagagctgcacattctatgatg

SEQ ID NO: 10054893 - DNA, 23 bp, Homo sapiens
cagagctgattaaacttaatctc

SEQ ID NO: 10054894 - DNA, 23 bp, Homo sapiens
cagagctgattaaacttaatctc

SEQ ID NO: 10054895 - DNA, 22 bp, Homo sapiens
cagagctgagaatgttgatgct

SEQ ID NO: 10054896 - DNA, 22 bp, Homo sapiens
cagagctgagtcttcaaggttg

SEQ ID NO: 10054897 - DNA, 22 bp, Homo sapiens
cagagctgctcatggtggccag

SEQ ID NO: 10054898 - DNA, 19 bp, Homo sapiens
cagagctgctggcctcgtc

SEQ ID NO: 10054899 - DNA, 22 bp, Homo sapiens
cagagctgcgctttttcctggt

SEQ ID NO: 10054900 - DNA, 22 bp, Homo sapiens
cagagctgcagattgaaggcat

SEQ ID NO: 10054901 - DNA, 22 bp, Homo sapiens
cagagtaaggagctgtcaaacg

SEQ ID NO: 10054902 - DNA, 22 bp, Homo sapiens
cagaggtgtacagagggaggcc

SEQ ID NO: 10054903 - DNA, 23 bp, Homo sapiens
cagaggtgtcagtgcccagtgtc

SEQ ID NO: 10054904 - DNA, 22 bp, Homo sapiens
gggtgctgaggaagacagcagg

SEQ ID NO: 10054905 - DNA, 22 bp, Homo sapiens
gggtgctgactggggcctgaaa

SEQ ID NO: 10054906 - DNA, 22 bp, Homo sapiens
cagaggcctggcttggacacct

SEQ ID NO: 10054907 - DNA, 22 bp, Homo sapiens
cagagctggtgttacaagtcca

SEQ ID NO: 10054908 - DNA, 22 bp, Homo sapiens
cagagctggtgtgtcctggcat

SEQ ID NO: 10054909 - DNA, 22 bp, Homo sapiens
cagagctgtatttatctttcca

SEQ ID NO: 10054910 - DNA, 22 bp, Homo sapiens
cagagctggtgttacaagtcca

SEQ ID NO: 10054911 - DNA, 22 bp, Homo sapiens
cagagctggtgtgtcctggcat

SEQ ID NO: 10054912 - DNA, 22 bp, Homo sapiens
cagagctggtaagtggtagagg

SEQ ID NO: 10054913 - DNA, 22 bp, Homo sapiens
cacagctgtgagaagggagcct

SEQ ID NO: 10054914 - DNA, 22 bp, Homo sapiens
cacagggaggcggtcactggct

SEQ ID NO: 10054915 - DNA, 19 bp, Homo sapiens
cacagggagaccacatgtc

SEQ ID NO: 10054916 - DNA, 19 bp, Homo sapiens
cacagggagaccacatgtc

SEQ ID NO: 10054917 - DNA, 22 bp, Homo sapiens
cacagggaggacatcaacagtg

SEQ ID NO: 10054918 - DNA, 22 bp, Homo sapiens
ggatgttctggggttctcttgt

SEQ ID NO: 10054919 - DNA, 22 bp, Homo sapiens
ggcagcatatattcagtgggca

SEQ ID NO: 10054920 - DNA, 22 bp, Homo sapiens
ggcagcatgagcctggtgaatt

SEQ ID NO: 10054921 - DNA, 22 bp, Homo sapiens
ggcagcattgcctttgcagtga

SEQ ID NO: 10054922 - DNA, 22 bp, Homo sapiens
ggcagccaccctgggaggcaga

SEQ ID NO: 10054923 - DNA, 20 bp, Homo sapiens
ggcactggaagcacacagga

SEQ ID NO: 10054924 - DNA, 18 bp, Homo sapiens
ggcactgctgttcccctt

SEQ ID NO: 10054925 - DNA, 22 bp, Homo sapiens
cacccagagcctgagagggata

SEQ ID NO: 10054926 - DNA, 22 bp, Homo sapiens
cacccagacatgtggtcccaga

SEQ ID NO: 10054927 - DNA, 22 bp, Homo sapiens
ggcagctgagatcatgctgttg

SEQ ID NO: 10054928 - DNA, 22 bp, Homo sapiens
ggcagctgagcatggctacctt

SEQ ID NO: 10054929 - DNA, 22 bp, Homo sapiens
ggcatcagaggtgtgttctgct

SEQ ID NO: 10054930 - DNA, 22 bp, Homo sapiens
cacccagttgactacaaagggg

SEQ ID NO: 10054931 - DNA, 22 bp, Homo sapiens
cacccagtgaaggagcaagagg

SEQ ID NO: 10054932 - DNA, 20 bp, Homo sapiens
caccctcccagcacctatgc

SEQ ID NO: 10054933 - DNA, 20 bp, Homo sapiens
caccctcccagcacctatgc

SEQ ID NO: 10054934 - DNA, 20 bp, Homo sapiens
caccctcccagcacctatgc

SEQ ID NO: 10054935 - DNA, 22 bp, Homo sapiens
cacccctgtggagcatggtggc

SEQ ID NO: 10054936 - DNA, 22 bp, Homo sapiens
cactgagaaagtgacctgccaa

SEQ ID NO: 10054937 - DNA, 22 bp, Homo sapiens
cactgagaggtctcatttccaa

SEQ ID NO: 10054938 - DNA, 22 bp, Homo sapiens
cactgagagatgtgtcacagca

SEQ ID NO: 10054939 - DNA, 22 bp, Homo sapiens
cactgagcaagtcagtacagca

SEQ ID NO: 10054940 - DNA, 22 bp, Homo sapiens
cactgagcaagtcagtacagca

SEQ ID NO: 10054941 - DNA, 22 bp, Homo sapiens
cactgagagtagggcacaagtg

SEQ ID NO: 10054942 - DNA, 22 bp, Homo sapiens
cactgcagcaccatgcagggct

SEQ ID NO: 10054943 - DNA, 22 bp, Homo sapiens
cactgcaggtctgagatggggg

SEQ ID NO: 10054944 - DNA, 22 bp, Homo sapiens
cactgcaggtctgagatggggg

SEQ ID NO: 10054945 - DNA, 22 bp, Homo sapiens
ggcctcgcggcttctggtggct

SEQ ID NO: 10054946 - DNA, 22 bp, Homo sapiens
cactgcagttccccagtgcgca

SEQ ID NO: 10054947 - DNA, 22 bp, Homo sapiens
cactgcagtaactctaggactg

SEQ ID NO: 10054948 - DNA, 22 bp, Homo sapiens
ggctatggcaaagaactcagat

SEQ ID NO: 10054949 - DNA, 22 bp, Homo sapiens
ggctatttcatttagtactagg

SEQ ID NO: 10054950 - DNA, 22 bp, Homo sapiens
ggctagggatctagaccaggac

SEQ ID NO: 10054951 - DNA, 20 bp, Homo sapiens
cactggaaagcaggcgactc

SEQ ID NO: 10054952 - DNA, 22 bp, Homo sapiens
cactggcattagtcacgaggca

SEQ ID NO: 10054953 - DNA, 22 bp, Homo sapiens
cactggataaaaatttggaagt

SEQ ID NO: 10054954 - DNA, 22 bp, Homo sapiens
cactggaggtcagtggagcact

SEQ ID NO: 10054955 - DNA, 22 bp, Homo sapiens
gctgtctccccgcacccgaccg

SEQ ID NO: 10054956 - DNA, 22 bp, Homo sapiens
gctgtacaaattccacaagaga

SEQ ID NO: 10054957 - DNA, 22 bp, Homo sapiens
caaggcagcccgctgaaccaca

SEQ ID NO: 10054958 - DNA, 22 bp, Homo sapiens
gctgtgctgcgggaggattccg

SEQ ID NO: 10054959 - DNA, 22 bp, Homo sapiens
gctgtgcttgggaagaatctct

SEQ ID NO: 10054960 - DNA, 22 bp, Homo sapiens
gctgtgcttgcatgagtgtctg

SEQ ID NO: 10054961 - DNA, 22 bp, Homo sapiens
gctgtggagtacagagctggtt

SEQ ID NO: 10054962 - DNA, 20 bp, Homo sapiens
gctgtggcaagtgctcactg

SEQ ID NO: 10054963 - DNA, 22 bp, Homo sapiens
gcttctcgggcctgatgtcgtc

SEQ ID NO: 10054964 - DNA, 19 bp, Homo sapiens
gcttgggagagggagctaa

SEQ ID NO: 10054965 - DNA, 22 bp, Homo sapiens
gcttgggagagggtccccagga

SEQ ID NO: 10054966 - DNA, 22 bp, Homo sapiens
gcttgggaggcaagcattccat

SEQ ID NO: 10054967 - DNA, 22 bp, Homo sapiens
gcttgggagaggcttcctcttt

SEQ ID NO: 10054968 - DNA, 22 bp, Homo sapiens
gcttgggaaacgtagttcctag

SEQ ID NO: 10054969 - DNA, 22 bp, Homo sapiens
gcttgggaagggccctgtgtac

SEQ ID NO: 10054970 - DNA, 22 bp, Homo sapiens
cacaaagtctgcagctgctgta

SEQ ID NO: 10054971 - DNA, 22 bp, Homo sapiens
cacaaaccttctgcagcctgta

SEQ ID NO: 10054972 - DNA, 22 bp, Homo sapiens
cacaaacctgccagccctgccc

SEQ ID NO: 10054973 - DNA, 22 bp, Homo sapiens
ggaaaatactgattcatgccat

SEQ ID NO: 10054974 - DNA, 22 bp, Homo sapiens
cacaatgcagcatgtaaatgca

SEQ ID NO: 10054975 - DNA, 22 bp, Homo sapiens
cacacgagccctggagccagca

SEQ ID NO: 10054976 - DNA, 22 bp, Homo sapiens
cacacctcacacctcgcatgct

SEQ ID NO: 10054977 - DNA, 22 bp, Homo sapiens
gctgcagagtgatgaagtgggg

SEQ ID NO: 10054978 - DNA, 22 bp, Homo sapiens
gctcctcttctcccactgaatg

SEQ ID NO: 10054979 - DNA, 22 bp, Homo sapiens
gctcctgccctcttgcaattcc

SEQ ID NO: 10054980 - DNA, 22 bp, Homo sapiens
gctgcatgacagacaggcctgg

SEQ ID NO: 10054981 - DNA, 22 bp, Homo sapiens
gctgcatgacagacaggcctgg

SEQ ID NO: 10054982 - DNA, 22 bp, Homo sapiens
gctgcatggagggtgcccagga

SEQ ID NO: 10054983 - DNA, 22 bp, Homo sapiens
caacagtgttgcaatctgaaaa

SEQ ID NO: 10054984 - DNA, 22 bp, Homo sapiens
caactaatatagggcatgagaa

SEQ ID NO: 10054985 - DNA, 22 bp, Homo sapiens
caactaatcctttgaaaagaag

SEQ ID NO: 10054986 - DNA, 22 bp, Homo sapiens
gctgctggcactggagtgagcc

SEQ ID NO: 10054987 - DNA, 22 bp, Homo sapiens
gctgctggagctttgcagaagg

SEQ ID NO: 10054988 - DNA, 22 bp, Homo sapiens
gctgctggcactggagtgagcc

SEQ ID NO: 10054989 - DNA, 22 bp, Homo sapiens
caaggacactgatgttcatcct

SEQ ID NO: 10054990 - DNA, 22 bp, Homo sapiens
caaggacactgagctttgtaaa

SEQ ID NO: 10054991 - DNA, 22 bp, Homo sapiens
attcagagattgttattcagac

SEQ ID NO: 10054992 - DNA, 21 bp, Homo sapiens
attcagagtaattcatcttta

SEQ ID NO: 10054993 - DNA, 22 bp, Homo sapiens
gcagagctgggatttgtactgg

SEQ ID NO: 10054994 - DNA, 22 bp, Homo sapiens
gcagagctgtctaagtcacttc

SEQ ID NO: 10054995 - DNA, 18 bp, Homo sapiens
gcagagctgggattccca

SEQ ID NO: 10054996 - DNA, 22 bp, Homo sapiens
gcagagctgcagcgaggcctgg

SEQ ID NO: 10054997 - DNA, 22 bp, Homo sapiens
gcagagctgcagcgaggcctgg

SEQ ID NO: 10054998 - DNA, 22 bp, Homo sapiens
attctcaaaacataacttcact

SEQ ID NO: 10054999 - DNA, 22 bp, Homo sapiens
attctcaatggctactttcata

SEQ ID NO: 10055000 - DNA, 22 bp, Homo sapiens
attcttcacaaatatatagaag

SEQ ID NO: 10055001 - DNA, 22 bp, Homo sapiens
attcttacaaagcagagtctgt

SEQ ID NO: 10055002 - DNA, 22 bp, Homo sapiens
attcttaaatttaggtctgtga

SEQ ID NO: 10055003 - DNA, 22 bp, Homo sapiens
attcttaattgccatgctgtat

SEQ ID NO: 10055004 - DNA, 23 bp, Homo sapiens
attgaacagagagaaaaacatcc

SEQ ID NO: 10055005 - DNA, 22 bp, Homo sapiens
attgacaatctactatgttctg

SEQ ID NO: 10055006 - DNA, 22 bp, Homo sapiens
attgacaagaaagatattttta

SEQ ID NO: 10055007 - DNA, 22 bp, Homo sapiens
attgacaaatctgaacatacgg

SEQ ID NO: 10055008 - DNA, 22 bp, Homo sapiens
attaatgaaactttggttaagc

SEQ ID NO: 10055009 - DNA, 22 bp, Homo sapiens
attaatgagcttctgcactcat

SEQ ID NO: 10055010 - DNA, 22 bp, Homo sapiens
gatgatcatctgtaaagttaga

SEQ ID NO: 10055011 - DNA, 22 bp, Homo sapiens
attaagatgtgggaaaatttaa

SEQ ID NO: 10055012 - DNA, 22 bp, Homo sapiens
attacaagtttcagtgttttgc

SEQ ID NO: 10055013 - DNA, 22 bp, Homo sapiens
attacaagtagactaactttca

SEQ ID NO: 10055014 - DNA, 22 bp, Homo sapiens
attacaagatgcatccatattt

SEQ ID NO: 10055015 - DNA, 22 bp, Homo sapiens
attacaataatacatgctcatt

SEQ ID NO: 10055016 - DNA, 22 bp, Homo sapiens
attattcaatcatattaaaagt

SEQ ID NO: 10055017 - DNA, 22 bp, Homo sapiens
attattcttatgtcatcatggc

SEQ ID NO: 10055018 - DNA, 22 bp, Homo sapiens
attattcttaatgcagggatta

SEQ ID NO: 10055019 - DNA, 22 bp, Homo sapiens
attaaatgttggacgtatacat

SEQ ID NO: 10055020 - DNA, 22 bp, Homo sapiens
gatgaggggtcattggctggga

SEQ ID NO: 10055021 - DNA, 22 bp, Homo sapiens
gatgagggcctggtggctgtgc

SEQ ID NO: 10055022 - DNA, 22 bp, Homo sapiens
atgtttttgagatacaaacaga

SEQ ID NO: 10055023 - DNA, 22 bp, Homo sapiens
atgttttgattggttaggtctg

SEQ ID NO: 10055024 - DNA, 22 bp, Homo sapiens
atgtgttaatgagcaatgacct

SEQ ID NO: 10055025 - DNA, 22 bp, Homo sapiens
atgtgtgtgtgcgcgcgcagga

SEQ ID NO: 10055026 - DNA, 22 bp, Homo sapiens
atgtgtgtgtttaatcctcaaa

SEQ ID NO: 10055027 - DNA, 22 bp, Homo sapiens
atgtgtgtgtatatacacacat

SEQ ID NO: 10055028 - DNA, 22 bp, Homo sapiens
caaaccttgttccagtcaactc

SEQ ID NO: 10055029 - DNA, 22 bp, Homo sapiens
caaaaaacacagatgtctgtgt

SEQ ID NO: 10055030 - DNA, 22 bp, Homo sapiens
caaaaaacacctgtgtgagtat

SEQ ID NO: 10055031 - DNA, 22 bp, Homo sapiens
caaaaaacacctgtgtgagtat

SEQ ID NO: 10055032 - DNA, 22 bp, Homo sapiens
caaaactatcaggctcaaagct

SEQ ID NO: 10055033 - DNA, 22 bp, Homo sapiens
caaaacattcagagagctcact

SEQ ID NO: 10055034 - DNA, 22 bp, Homo sapiens
caaaactgtctagagagagaag

SEQ ID NO: 10055035 - DNA, 22 bp, Homo sapiens
gcctgggagggcagcagtgtgg

SEQ ID NO: 10055036 - DNA, 22 bp, Homo sapiens
gcctgtcctatacaggcggctg

SEQ ID NO: 10055037 - DNA, 22 bp, Homo sapiens
gcctgtcctatacaggcggctg

SEQ ID NO: 10055038 - DNA, 22 bp, Homo sapiens
gcctgtccttgtgaggtcccag

SEQ ID NO: 10055039 - DNA, 21 bp, Homo sapiens
gcctctccaaatcctgccttc

SEQ ID NO: 10055040 - DNA, 22 bp, Homo sapiens
gcctcgaggctgagaaggcaca

SEQ ID NO: 10055041 - DNA, 22 bp, Homo sapiens
gcctccagtttttttctgaact

SEQ ID NO: 10055042 - DNA, 22 bp, Homo sapiens
gcctgggagcacatcggggtcc

SEQ ID NO: 10055043 - DNA, 22 bp, Homo sapiens
gcctgggagatgcgttgtggcc

SEQ ID NO: 10055044 - DNA, 22 bp, Homo sapiens
gcctgggagagggatagtgcag

SEQ ID NO: 10055045 - DNA, 22 bp, Homo sapiens
gcctgctgaacctcatgcagtc

SEQ ID NO: 10055046 - DNA, 22 bp, Homo sapiens
gcctgctggaggagcctcaggg

SEQ ID NO: 10055047 - DNA, 22 bp, Homo sapiens
atttaaattttctgatggagag

SEQ ID NO: 10055048 - DNA, 22 bp, Homo sapiens
atttaatgggtagacattgtta

SEQ ID NO: 10055049 - DNA, 22 bp, Homo sapiens
atttaatttacatttgacagag

SEQ ID NO: 10055050 - DNA, 22 bp, Homo sapiens
atttaatttatagatgtggata

SEQ ID NO: 10055051 - DNA, 22 bp, Homo sapiens
atttaatttggagagagaaacc

SEQ ID NO: 10055052 - DNA, 22 bp, Homo sapiens
atttaattttctcaacagtgct

SEQ ID NO: 10055053 - DNA, 22 bp, Homo sapiens
atttagaagctaatttttcaga

SEQ ID NO: 10055054 - DNA, 22 bp, Homo sapiens
atttagaaattccaaaagtatt

SEQ ID NO: 10055055 - DNA, 22 bp, Homo sapiens
atttcatagattgtaaatccct

SEQ ID NO: 10055056 - DNA, 22 bp, Homo sapiens
atttcatctctggaacataact

SEQ ID NO: 10055057 - DNA, 22 bp, Homo sapiens
atttcagagtagatcgttattt

SEQ ID NO: 10055058 - DNA, 22 bp, Homo sapiens
atttcagagtgagagtgctcaa

SEQ ID NO: 10055059 - DNA, 22 bp, Homo sapiens
atttcagagaatgaacctaatc

SEQ ID NO: 10055060 - DNA, 21 bp, Homo sapiens
atttcagagcacacaagtaaa

SEQ ID NO: 10055061 - DNA, 22 bp, Homo sapiens
atttagaagctaatttttcaga

SEQ ID NO: 10055062 - DNA, 20 bp, Homo sapiens
atgagtttaaacattcagag

SEQ ID NO: 10055063 - DNA, 22 bp, Homo sapiens
atgcaaaaactgcacttacgct

SEQ ID NO: 10055064 - DNA, 22 bp, Homo sapiens
atgcaaaataaggcagaaacat

SEQ ID NO: 10055065 - DNA, 22 bp, Homo sapiens
atgcaaaattaccattctgttc

SEQ ID NO: 10055066 - DNA, 22 bp, Homo sapiens
atgcaaaattaccattctgttc

SEQ ID NO: 10055067 - DNA, 22 bp, Homo sapiens
atgcaaaattaccattctgttc

SEQ ID NO: 10055068 - DNA, 22 bp, Homo sapiens
atgcaaagcacacacagaatcc

SEQ ID NO: 10055069 - DNA, 22 bp, Homo sapiens
atgcaaagcaccacactaagat

SEQ ID NO: 10055070 - DNA, 22 bp, Homo sapiens
atgcagaaggagccatgcttgc

SEQ ID NO: 10055071 - DNA, 22 bp, Homo sapiens
atgcagagacagatgtggcatg

SEQ ID NO: 10055072 - DNA, 22 bp, Homo sapiens
atcttcttcaaggatctggagc

SEQ ID NO: 10055073 - DNA, 19 bp, Homo sapiens
cttgtaaagggctgtttct

SEQ ID NO: 10055074 - DNA, 22 bp, Homo sapiens
cttgtaaatgcagattctgatt

SEQ ID NO: 10055075 - DNA, 22 bp, Homo sapiens
cttggcatgttcatctgcttgg

SEQ ID NO: 10055076 - DNA, 22 bp, Homo sapiens
cttgcctttgtcttcaaaggct

SEQ ID NO: 10055077 - DNA, 22 bp, Homo sapiens
cttgcctttgtcttcaaaggct

SEQ ID NO: 10055078 - DNA, 19 bp, Homo sapiens
atctacaattattctcagt

SEQ ID NO: 10055079 - DNA, 22 bp, Homo sapiens
ctttggtgtcatgtttctgcgg

SEQ ID NO: 10055080 - DNA, 22 bp, Homo sapiens
cttttcatgagtctgttatggg

SEQ ID NO: 10055081 - DNA, 23 bp, Homo sapiens
atgaaatgctggctcagggaggt

SEQ ID NO: 10055082 - DNA, 22 bp, Homo sapiens
atgaaatgattgaaatctttac

SEQ ID NO: 10055083 - DNA, 22 bp, Homo sapiens
atgaaaagttcgatctagaagg

SEQ ID NO: 10055084 - DNA, 22 bp, Homo sapiens
atgaaaagcataaacgctgaag

SEQ ID NO: 10055085 - DNA, 22 bp, Homo sapiens
cttgtttaataataccttagca

SEQ ID NO: 10055086 - DNA, 18 bp, Homo sapiens
cttgttcttctcttggcg

SEQ ID NO: 10055087 - DNA, 22 bp, Homo sapiens
atcttgattccattatctttgt

SEQ ID NO: 10055088 - DNA, 22 bp, Homo sapiens
atctttgttgctctcatttctg

SEQ ID NO: 10055089 - DNA, 22 bp, Homo sapiens
atctttttatctgtttggaaca

SEQ ID NO: 10055090 - DNA, 22 bp, Homo sapiens
atgaaaacggaccagagctatt

SEQ ID NO: 10055091 - DNA, 22 bp, Homo sapiens
atggtattaagaacaattccaa

SEQ ID NO: 10055092 - DNA, 22 bp, Homo sapiens
atggtattggagtaggacttgc

SEQ ID NO: 10055093 - DNA, 22 bp, Homo sapiens
atggtattctcagcacctagca

SEQ ID NO: 10055094 - DNA, 22 bp, Homo sapiens
atggtattctctaactcagctt

SEQ ID NO: 10055095 - DNA, 22 bp, Homo sapiens
atggtattcctttatgtagaag

SEQ ID NO: 10055096 - DNA, 22 bp, Homo sapiens
gagctgggcctgcgagtgctgc

SEQ ID NO: 10055097 - DNA, 22 bp, Homo sapiens
gagctgggctggcttcctccct

SEQ ID NO: 10055098 - DNA, 22 bp, Homo sapiens
atgtgtgtatgtgcctatatct

SEQ ID NO: 10055099 - DNA, 22 bp, Homo sapiens
atgtgtgtatatatagtcattt

SEQ ID NO: 10055100 - DNA, 22 bp, Homo sapiens
atgtgtgtgcatttctctccct

SEQ ID NO: 10055101 - DNA, 22 bp, Homo sapiens
atgtgtgtgatgggcgccgcca

SEQ ID NO: 10055102 - DNA, 22 bp, Homo sapiens
gaggggaagacttctggacagt

SEQ ID NO: 10055103 - DNA, 22 bp, Homo sapiens
atgtgaaacctgtgagtagagt

SEQ ID NO: 10055104 - DNA, 22 bp, Homo sapiens
atgtcttttatggagatgtcat

SEQ ID NO: 10055105 - DNA, 22 bp, Homo sapiens
atgtgaaaaatttcttattaca

SEQ ID NO: 10055106 - DNA, 22 bp, Homo sapiens
atgtctttgccatagttcatat

SEQ ID NO: 10055107 - DNA, 22 bp, Homo sapiens
atgtctttctcatacaagccca

SEQ ID NO: 10055108 - DNA, 22 bp, Homo sapiens
atgtctttctagttaagagcta

SEQ ID NO: 10055109 - DNA, 22 bp, Homo sapiens
atgtctttataaatgtataatg

SEQ ID NO: 10055110 - DNA, 22 bp, Homo sapiens
gaggccagggtaccatcaacat

SEQ ID NO: 10055111 - DNA, 22 bp, Homo sapiens
atggaagtgcaacttgctcatc

SEQ ID NO: 10055112 - DNA, 22 bp, Homo sapiens
gagaaatgagtgattcactttt

SEQ ID NO: 10055113 - DNA, 22 bp, Homo sapiens
atgccactgcgctccagcctgg

SEQ ID NO: 10055114 - DNA, 22 bp, Homo sapiens
atggaacatcaggttaagaaat

SEQ ID NO: 10055115 - DNA, 22 bp, Homo sapiens
gacagaggcaagaccagaagcc

SEQ ID NO: 10055116 - DNA, 22 bp, Homo sapiens
gacagaggctggagcacctcct

SEQ ID NO: 10055117 - DNA, 22 bp, Homo sapiens
atgccactgcacttcagcttgg

SEQ ID NO: 10055118 - DNA, 22 bp, Homo sapiens
atggccagtctgttggacagca

SEQ ID NO: 10055119 - DNA, 22 bp, Homo sapiens
gagccagctacatggtctgcaa

SEQ ID NO: 10055120 - DNA, 22 bp, Homo sapiens
gagccagctatgtagcaagagg

SEQ ID NO: 10055121 - DNA, 22 bp, Homo sapiens
gagccaggaggcagagactgca

SEQ ID NO: 10055122 - DNA, 22 bp, Homo sapiens
gagagctgtgttcattctacca

SEQ ID NO: 10055123 - DNA, 22 bp, Homo sapiens
gagagctgtggtttgaccaggc

SEQ ID NO: 10055124 - DNA, 22 bp, Homo sapiens
atggcaggatacccagtccggc

SEQ ID NO: 10055125 - DNA, 22 bp, Homo sapiens
gagaacagaagcattcctaatt

SEQ ID NO: 10055126 - DNA, 22 bp, Homo sapiens
atggcagtatttgtatcacaga

SEQ ID NO: 10055127 - DNA, 22 bp, Homo sapiens
attaaatactgcaggctaagca

SEQ ID NO: 10055128 - DNA, 22 bp, Homo sapiens
attaaagttgaaattgaactga

SEQ ID NO: 10055129 - DNA, 22 bp, Homo sapiens
attagtttggtgcaaaagtaat

SEQ ID NO: 10055130 - DNA, 22 bp, Homo sapiens
attaaagaaacccagcatgtga

SEQ ID NO: 10055131 - DNA, 22 bp, Homo sapiens
atgttaaatagccatttgtttg

SEQ ID NO: 10055132 - DNA, 20 bp, Homo sapiens
atgttaaatagcatttagag

SEQ ID NO: 10055133 - DNA, 22 bp, Homo sapiens
atgtgtgtacacacgtgactct

SEQ ID NO: 10055134 - DNA, 23 bp, Homo sapiens
atgttaaacataactgaagagcc

SEQ ID NO: 10055135 - DNA, 22 bp, Homo sapiens
atgttaaagatggtgggaaatt

SEQ ID NO: 10055136 - DNA, 22 bp, Homo sapiens
atgttaaataatcccttaaagc

SEQ ID NO: 10055137 - DNA, 22 bp, Homo sapiens
atgtgtgtaaacaagtataatt

SEQ ID NO: 10055138 - DNA, 22 bp, Homo sapiens
attataaacctttgagggtggg

SEQ ID NO: 10055139 - DNA, 22 bp, Homo sapiens
attataaagaacatgtgtgtgg

SEQ ID NO: 10055140 - DNA, 22 bp, Homo sapiens
attataaatattttctaggggt

SEQ ID NO: 10055141 - DNA, 22 bp, Homo sapiens
attatagagggttacagttaat

SEQ ID NO: 10055142 - DNA, 22 bp, Homo sapiens
attatagagggttacagttaat

SEQ ID NO: 10055143 - DNA, 22 bp, Homo sapiens
attcacaattagaagtagataa

SEQ ID NO: 10055144 - DNA, 22 bp, Homo sapiens
attcagagtctgcacaacagca

SEQ ID NO: 10055145 - DNA, 22 bp, Homo sapiens
attctggccttggctctgtcac

SEQ ID NO: 10055146 - DNA, 22 bp, Homo sapiens
agaggggctcatatcctgtcat

SEQ ID NO: 10055147 - DNA, 22 bp, Homo sapiens
atttagcaaaaaatgatgaagc

SEQ ID NO: 10055148 - DNA, 22 bp, Homo sapiens
agagtgggcctctgagtcccag

SEQ ID NO: 10055149 - DNA, 22 bp, Homo sapiens
agagtgggcctctgagtcccag

SEQ ID NO: 10055150 - DNA, 22 bp, Homo sapiens
attcttcctcatcaatctgtag

SEQ ID NO: 10055151 - DNA, 18 bp, Homo sapiens
atttaatgaactgaaagc

SEQ ID NO: 10055152 - DNA, 23 bp, Homo sapiens
atttaatgctgagttgaatgtta

SEQ ID NO: 10055153 - DNA, 22 bp, Homo sapiens
agatgtaaactctcatgtcatt

SEQ ID NO: 10055154 - DNA, 22 bp, Homo sapiens
agatgaaatttgtgttgagttg

SEQ ID NO: 10055155 - DNA, 23 bp, Homo sapiens
agatgaaagcttcccatcacagt

SEQ ID NO: 10055156 - DNA, 18 bp, Homo sapiens
agatgaaagcaaatgaca

SEQ ID NO: 10055157 - DNA, 22 bp, Homo sapiens
agatgaaaatacgtgactttaa

SEQ ID NO: 10055158 - DNA, 22 bp, Homo sapiens
agatgaaagatttttatagaga

SEQ ID NO: 10055159 - DNA, 22 bp, Homo sapiens
agatgaaaagataagcagcaat

SEQ ID NO: 10055160 - DNA, 17 bp, Homo sapiens
agcaaaagtatcaaagc

SEQ ID NO: 10055161 - DNA, 22 bp, Homo sapiens
agatttcacatgctgctctatt

SEQ ID NO: 10055162 - DNA, 22 bp, Homo sapiens
agcaaaataaggtaatttattg

SEQ ID NO: 10055163 - DNA, 20 bp, Homo sapiens
agcaaaatgcaagattttca

SEQ ID NO: 10055164 - DNA, 22 bp, Homo sapiens
agcaaacagtgtgctaagaaat

SEQ ID NO: 10055165 - DNA, 19 bp, Homo sapiens
atggaaaatgccagactga

SEQ ID NO: 10055166 - DNA, 19 bp, Homo sapiens
atggaaaattgtactcaat

SEQ ID NO: 10055167 - DNA, 22 bp, Homo sapiens
agacgctattttgaggggtcta

SEQ ID NO: 10055168 - DNA, 21 bp, Homo sapiens
atggagtcaggggaatgggcc

SEQ ID NO: 10055169 - DNA, 22 bp, Homo sapiens
atggcagatggctggagcaggt

SEQ ID NO: 10055170 - DNA, 20 bp, Homo sapiens
atgtccagtgactggaccat

SEQ ID NO: 10055171 - DNA, 23 bp, Homo sapiens
atgtccagtttacttcaggatga

SEQ ID NO: 10055172 - DNA, 22 bp, Homo sapiens
atgtacagtgataagagggcag

SEQ ID NO: 10055173 - DNA, 22 bp, Homo sapiens
atgtacaggtcttggcaaaggg

SEQ ID NO: 10055174 - DNA, 22 bp, Homo sapiens
atgtacaggatggtgctcatct

SEQ ID NO: 10055175 - DNA, 22 bp, Homo sapiens
atgtacagccacttcacagtta

SEQ ID NO: 10055176 - DNA, 22 bp, Homo sapiens
atgtacagtggaaactaacaaa

SEQ ID NO: 10055177 - DNA, 22 bp, Homo sapiens
atgtacagtttctagactcaaa

SEQ ID NO: 10055178 - DNA, 22 bp, Homo sapiens
atgtccagaggcttggtcccca

SEQ ID NO: 10055179 - DNA, 20 bp, Homo sapiens
atgtaaaattataaggctga

SEQ ID NO: 10055180 - DNA, 22 bp, Homo sapiens
atgtaaaagattattttcctgt

SEQ ID NO: 10055181 - DNA, 22 bp, Homo sapiens
atgtaaaggcagactttaattt

SEQ ID NO: 10055182 - DNA, 22 bp, Homo sapiens
atgtaaagggcatggtattggg

SEQ ID NO: 10055183 - DNA, 20 bp, Homo sapiens
atgtaaaagacagggagtag

SEQ ID NO: 10055184 - DNA, 22 bp, Homo sapiens
atggtttgtgtggcccagatga

SEQ ID NO: 10055185 - DNA, 22 bp, Homo sapiens
atggtttgtgtggcccagatga

SEQ ID NO: 10055186 - DNA, 22 bp, Homo sapiens
atggtttgtaacccaatactcc

SEQ ID NO: 10055187 - DNA, 22 bp, Homo sapiens
atgggtggccccgtgtgcagtc

SEQ ID NO: 10055188 - DNA, 22 bp, Homo sapiens
agaatacaattgttcagtaata

SEQ ID NO: 10055189 - DNA, 22 bp, Homo sapiens
agaagtttggtccttttcaagg

SEQ ID NO: 10055190 - DNA, 20 bp, Homo sapiens
agaaggctccttttgccaag

SEQ ID NO: 10055191 - DNA, 22 bp, Homo sapiens
atctttatatatctcctctgaa

SEQ ID NO: 10055192 - DNA, 22 bp, Homo sapiens
agaatactaggcttcagaaagg

SEQ ID NO: 10055193 - DNA, 22 bp, Homo sapiens
agaatacatctagtgctgcatg

SEQ ID NO: 10055194 - DNA, 22 bp, Homo sapiens
atctttggtactattcttatca

SEQ ID NO: 10055195 - DNA, 22 bp, Homo sapiens
atctttggtgcttggtgctccc

SEQ ID NO: 10055196 - DNA, 22 bp, Homo sapiens
atctttggtgcatgatactttg

SEQ ID NO: 10055197 - DNA, 20 bp, Homo sapiens
atctttgtctctgtagttgt

SEQ ID NO: 10055198 - DNA, 22 bp, Homo sapiens
agaagacagagtctacattcta

SEQ ID NO: 10055199 - DNA, 22 bp, Homo sapiens
agaagaatttctctcatgattt

SEQ ID NO: 10055200 - DNA, 22 bp, Homo sapiens
agaagaatacttgatgttcatg

SEQ ID NO: 10055201 - DNA, 22 bp, Homo sapiens
agaagaacttagctttctatct

SEQ ID NO: 10055202 - DNA, 22 bp, Homo sapiens
agaagagtagtaacagaaatta

SEQ ID NO: 10055203 - DNA, 22 bp, Homo sapiens
atctttaaagacatgtgaactt

SEQ ID NO: 10055204 - DNA, 18 bp, Homo sapiens
atcttgtttttggattaa

SEQ ID NO: 10055205 - DNA, 22 bp, Homo sapiens
atcttgttctcccttgttctta

SEQ ID NO: 10055206 - DNA, 18 bp, Homo sapiens
agaagcacaagatgtctt

SEQ ID NO: 10055207 - DNA, 22 bp, Homo sapiens
agaagcaaggtctgtcagtata

SEQ ID NO: 10055208 - DNA, 22 bp, Homo sapiens
agaatgcatctaaaagcagaga

SEQ ID NO: 10055209 - DNA, 17 bp, Homo sapiens
agaatgcaaagcaggct

SEQ ID NO: 10055210 - DNA, 22 bp, Homo sapiens
agaatgctcttcaaaatctagc

SEQ ID NO: 10055211 - DNA, 22 bp, Homo sapiens
agaatgcttgtacctttgtttt

SEQ ID NO: 10055212 - DNA, 22 bp, Homo sapiens
agaatgtgttattagagaagga

SEQ ID NO: 10055213 - DNA, 22 bp, Homo sapiens
agaattctgacaatagaattgg

SEQ ID NO: 10055214 - DNA, 22 bp, Homo sapiens
agacacagaagttgctgttggg

SEQ ID NO: 10055215 - DNA, 22 bp, Homo sapiens
agacacagaacacaaaagcata

SEQ ID NO: 10055216 - DNA, 19 bp, Homo sapiens
agacacacttacgtggaat

SEQ ID NO: 10055217 - DNA, 22 bp, Homo sapiens
agacacatcttaggttgtcagg

SEQ ID NO: 10055218 - DNA, 19 bp, Homo sapiens
agacacatcacatttctcc

SEQ ID NO: 10055219 - DNA, 22 bp, Homo sapiens
agacacatcttaggttgtcagg

SEQ ID NO: 10055220 - DNA, 23 bp, Homo sapiens
agacacataggagcagctattgg

SEQ ID NO: 10055221 - DNA, 22 bp, Homo sapiens
agacacagtgctgggtgctgag

SEQ ID NO: 10055222 - DNA, 22 bp, Homo sapiens
agacacagtctgtctggaggag

SEQ ID NO: 10055223 - DNA, 22 bp, Homo sapiens
agacacagctgcaggaggtggg

SEQ ID NO: 10055224 - DNA, 22 bp, Homo sapiens
agacacaggattctgcatttct

SEQ ID NO: 10055225 - DNA, 21 bp, Homo sapiens
agacacaggggttgctggggt

SEQ ID NO: 10055226 - DNA, 22 bp, Homo sapiens
agacacagctaccataatacca

SEQ ID NO: 10055227 - DNA, 22 bp, Homo sapiens
agacacagctaccataatacca

SEQ ID NO: 10055228 - DNA, 22 bp, Homo sapiens
agacacagtataagcacaacaa

SEQ ID NO: 10055229 - DNA, 22 bp, Homo sapiens
agacacaggtgtaatttctgct

SEQ ID NO: 10055230 - DNA, 21 bp, Homo sapiens
atgcaggctgctcagaagcaa

SEQ ID NO: 10055231 - DNA, 21 bp, Homo sapiens
atgcaggctgctcagaagcaa

SEQ ID NO: 10055232 - DNA, 22 bp, Homo sapiens
caactgttataaatcaacagag

SEQ ID NO: 10055233 - DNA, 22 bp, Homo sapiens
agcagacaacccagatgaccca

SEQ ID NO: 10055234 - DNA, 22 bp, Homo sapiens
caactatatagaaattgattgt

SEQ ID NO: 10055235 - DNA, 22 bp, Homo sapiens
agcagcacgagtccacaaatcc

SEQ ID NO: 10055236 - DNA, 22 bp, Homo sapiens
agcagcacctgtcctcgctgct

SEQ ID NO: 10055237 - DNA, 22 bp, Homo sapiens
agcagcacccagagccatgtct

SEQ ID NO: 10055238 - DNA, 22 bp, Homo sapiens
agcagcacccagagccatgtct

SEQ ID NO: 10055239 - DNA, 22 bp, Homo sapiens
agcagcaatggaaagcaacaca

SEQ ID NO: 10055240 - DNA, 22 bp, Homo sapiens
agcagcacacgggagaaagaca

SEQ ID NO: 10055241 - DNA, 22 bp, Homo sapiens
agcagcatagaagctgggagga

SEQ ID NO: 10055242 - DNA, 22 bp, Homo sapiens
agcagcatttaaggatccaagt

SEQ ID NO: 10055243 - DNA, 20 bp, Homo sapiens
agcagcattgttctagagca

SEQ ID NO: 10055244 - DNA, 22 bp, Homo sapiens
agcagcattctctggtatgggg

SEQ ID NO: 10055245 - DNA, 22 bp, Homo sapiens
agcagcattatgatatatctta

SEQ ID NO: 10055246 - DNA, 22 bp, Homo sapiens
agcagcatgatgacagagtctc

SEQ ID NO: 10055247 - DNA, 22 bp, Homo sapiens
agcagcatgatgacagagtctc

SEQ ID NO: 10055248 - DNA, 22 bp, Homo sapiens
agcagcatctggttctgatgtg

SEQ ID NO: 10055249 - DNA, 22 bp, Homo sapiens
caaatgcaggtcagcaggtgtc

SEQ ID NO: 10055250 - DNA, 22 bp, Homo sapiens
agcactgttatgggatgactta

SEQ ID NO: 10055251 - DNA, 22 bp, Homo sapiens
caaatgtttttattctacaaca

SEQ ID NO: 10055252 - DNA, 22 bp, Homo sapiens
caaatgtttcttgaacaccaac

SEQ ID NO: 10055253 - DNA, 22 bp, Homo sapiens
agcagttcataaacattttgag

SEQ ID NO: 10055254 - DNA, 22 bp, Homo sapiens
agcaggtgcgttacttcactct

SEQ ID NO: 10055255 - DNA, 22 bp, Homo sapiens
cacatctgacttccagtgcagg

SEQ ID NO: 10055256 - DNA, 22 bp, Homo sapiens
cacatccctggagttacccagt

SEQ ID NO: 10055257 - DNA, 22 bp, Homo sapiens
cacatctgaaaagatgcacaag

SEQ ID NO: 10055258 - DNA, 22 bp, Homo sapiens
cacagtccagactcctggagtt

SEQ ID NO: 10055259 - DNA, 22 bp, Homo sapiens
cacagggcaggtactctcagag

SEQ ID NO: 10055260 - DNA, 22 bp, Homo sapiens
cacagggcaggtactctcagag

SEQ ID NO: 10055261 - DNA, 19 bp, Homo sapiens
cacagggcaggtctcatgt

SEQ ID NO: 10055262 - DNA, 22 bp, Homo sapiens
cacagggccactttcccagtaa

SEQ ID NO: 10055263 - DNA, 22 bp, Homo sapiens
caatgacatctccctgctctaa

SEQ ID NO: 10055264 - DNA, 21 bp, Homo sapiens
agcagctgggcaacatggagg

SEQ ID NO: 10055265 - DNA, 18 bp, Homo sapiens
agcagctgtcagaatgcc

SEQ ID NO: 10055266 - DNA, 22 bp, Homo sapiens
agctcacagtgtccttcctcaa

SEQ ID NO: 10055267 - DNA, 21 bp, Homo sapiens
agctcacagttctgtcctgtc

SEQ ID NO: 10055268 - DNA, 22 bp, Homo sapiens
agctcacagcctagcactgtga

SEQ ID NO: 10055269 - DNA, 22 bp, Homo sapiens
agccttgctttttcagtagcac

SEQ ID NO: 10055270 - DNA, 22 bp, Homo sapiens
agccttgtagaccattttaagg

SEQ ID NO: 10055271 - DNA, 22 bp, Homo sapiens
cagcaggaccattgaggcatca

SEQ ID NO: 10055272 - DNA, 22 bp, Homo sapiens
agctccagggaaagagtggatc

SEQ ID NO: 10055273 - DNA, 22 bp, Homo sapiens
agccctccatctgtgctcaggc

SEQ ID NO: 10055274 - DNA, 22 bp, Homo sapiens
cagcacagctgaggggctgtct

SEQ ID NO: 10055275 - DNA, 22 bp, Homo sapiens
cagcacagtacaaggcacggat

SEQ ID NO: 10055276 - DNA, 23 bp, Homo sapiens
agcctcagccggtggcagaagtg

SEQ ID NO: 10055277 - DNA, 22 bp, Homo sapiens
cagcacagggcttgagaggtgt

SEQ ID NO: 10055278 - DNA, 22 bp, Homo sapiens
cagcacaggcctgtctttgtct

SEQ ID NO: 10055279 - DNA, 22 bp, Homo sapiens
cagcacaggcccctctctccca

SEQ ID NO: 10055280 - DNA, 22 bp, Homo sapiens
cagcagaggaaagcaaatctaa

SEQ ID NO: 10055281 - DNA, 22 bp, Homo sapiens
agcctcagtttcaggcctcctc

SEQ ID NO: 10055282 - DNA, 22 bp, Homo sapiens
cagcagcagcttagtggtcccc

SEQ ID NO: 10055283 - DNA, 22 bp, Homo sapiens
cagcagcagccccaggaaggtt

SEQ ID NO: 10055284 - DNA, 22 bp, Homo sapiens
cagcagcagcttagtggtcccc

SEQ ID NO: 10055285 - DNA, 22 bp, Homo sapiens
cagcagcagtggctgcagaaca

SEQ ID NO: 10055286 - DNA, 22 bp, Homo sapiens
cagcagcagtggctgcagaaca

SEQ ID NO: 10055287 - DNA, 22 bp, Homo sapiens
cagcagcatcaggtctgtggtt

SEQ ID NO: 10055288 - DNA, 22 bp, Homo sapiens
cagcagcatgaattcgagccac

SEQ ID NO: 10055289 - DNA, 22 bp, Homo sapiens
cagcagcatcaggtctgtggtt

SEQ ID NO: 10055290 - DNA, 22 bp, Homo sapiens
cagcagcatgaattcgagccac

SEQ ID NO: 10055291 - DNA, 22 bp, Homo sapiens
agcctgtccagaggacagggct

SEQ ID NO: 10055292 - DNA, 22 bp, Homo sapiens
cagagctggcggtgagaagaca

SEQ ID NO: 10055293 - DNA, 22 bp, Homo sapiens
cagagctggcctgtgatttttg

SEQ ID NO: 10055294 - DNA, 22 bp, Homo sapiens
cagagctggagggaaccctggc

SEQ ID NO: 10055295 - DNA, 22 bp, Homo sapiens
cagagctggagcttgaatggag

SEQ ID NO: 10055296 - DNA, 22 bp, Homo sapiens
cagagctggagaagtggattta

SEQ ID NO: 10055297 - DNA, 22 bp, Homo sapiens
cagagctggacttaaatatatt

SEQ ID NO: 10055298 - DNA, 22 bp, Homo sapiens
cagagctgcttcccagtttgtg

SEQ ID NO: 10055299 - DNA, 22 bp, Homo sapiens
cagagctgcttcccagtttgtg

SEQ ID NO: 10055300 - DNA, 22 bp, Homo sapiens
cagacagagtcttcccatcagt

SEQ ID NO: 10055301 - DNA, 22 bp, Homo sapiens
cagacagcaaatctgcttgcat

SEQ ID NO: 10055302 - DNA, 22 bp, Homo sapiens
cagagagggcggccctggcttc

SEQ ID NO: 10055303 - DNA, 22 bp, Homo sapiens
cagagatgtgatccagctgtct

SEQ ID NO: 10055304 - DNA, 22 bp, Homo sapiens
cagagagggagcagtagtctct

SEQ ID NO: 10055305 - DNA, 21 bp, Homo sapiens
agccagtctgttttctagtgc

SEQ ID NO: 10055306 - DNA, 22 bp, Homo sapiens
cagacagaaggctccttgaggt

SEQ ID NO: 10055307 - DNA, 22 bp, Homo sapiens
agccaggatggtctcgatcggc

SEQ ID NO: 10055308 - DNA, 21 bp, Homo sapiens
agccagctatcacacagcatt

SEQ ID NO: 10055309 - DNA, 22 bp, Homo sapiens
cagaagcattccagcaaatagt

SEQ ID NO: 10055310 - DNA, 22 bp, Homo sapiens
cagaagctgaggagtgaggcaa

SEQ ID NO: 10055311 - DNA, 22 bp, Homo sapiens
cagaagcctgcctcagatgcac

SEQ ID NO: 10055312 - DNA, 22 bp, Homo sapiens
cagaagcctaaatagtgcacca

SEQ ID NO: 10055313 - DNA, 23 bp, Homo sapiens
agccacagccagagctatctcca

SEQ ID NO: 10055314 - DNA, 22 bp, Homo sapiens
agccacagagagggagctgcaa

SEQ ID NO: 10055315 - DNA, 22 bp, Homo sapiens
acatgagattagctcacccact

SEQ ID NO: 10055316 - DNA, 22 bp, Homo sapiens
acatgcacacgattcagtctgg

SEQ ID NO: 10055317 - DNA, 22 bp, Homo sapiens
acatgaaagttattctgagttg

SEQ ID NO: 10055318 - DNA, 22 bp, Homo sapiens
aggcagggctgggattagactc

SEQ ID NO: 10055319 - DNA, 22 bp, Homo sapiens
aggcaggcagctgtcaccactc

SEQ ID NO: 10055320 - DNA, 17 bp, Homo sapiens
aggcaggcagagcggga

SEQ ID NO: 10055321 - DNA, 22 bp, Homo sapiens
aggcaggctggtctgaagagtg

SEQ ID NO: 10055322 - DNA, 22 bp, Homo sapiens
acatggcaggaatcatgtgttt

SEQ ID NO: 10055323 - DNA, 22 bp, Homo sapiens
aggcccttcttggtggctcagg

SEQ ID NO: 10055324 - DNA, 22 bp, Homo sapiens
aggcccttggactcatgctcga

SEQ ID NO: 10055325 - DNA, 22 bp, Homo sapiens
aggctgagggctcctgagggca

SEQ ID NO: 10055326 - DNA, 22 bp, Homo sapiens
aggctgaggctggcagctccag

SEQ ID NO: 10055327 - DNA, 19 bp, Homo sapiens
acatttaaattcagatctc

SEQ ID NO: 10055328 - DNA, 22 bp, Homo sapiens
acatttaaccaaactgtttaat

SEQ ID NO: 10055329 - DNA, 22 bp, Homo sapiens
acatttaaccctcaggtttctg

SEQ ID NO: 10055330 - DNA, 22 bp, Homo sapiens
acatttaagttaaaacctcagt

SEQ ID NO: 10055331 - DNA, 22 bp, Homo sapiens
accaaaacctgctactaaagga

SEQ ID NO: 10055332 - DNA, 21 bp, Homo sapiens
accaaaacctatactttctgt

SEQ ID NO: 10055333 - DNA, 22 bp, Homo sapiens
acatttgtcttctttcagatta

SEQ ID NO: 10055334 - DNA, 22 bp, Homo sapiens
accaggcccgctgctatggtgg

SEQ ID NO: 10055335 - DNA, 20 bp, Homo sapiens
accaggcccggtgtctcctc

SEQ ID NO: 10055336 - DNA, 19 bp, Homo sapiens
accaggcctcagaggccct

SEQ ID NO: 10055337 - DNA, 22 bp, Homo sapiens
acccaagttttccatgcctgtt

SEQ ID NO: 10055338 - DNA, 22 bp, Homo sapiens
accatcagtcacatgtagagaa

SEQ ID NO: 10055339 - DNA, 22 bp, Homo sapiens
accatcagtactggatgctgac

SEQ ID NO: 10055340 - DNA, 22 bp, Homo sapiens
accatcagagcacagtccgtgc

SEQ ID NO: 10055341 - DNA, 22 bp, Homo sapiens
accctcaacaaattcactctat

SEQ ID NO: 10055342 - DNA, 22 bp, Homo sapiens
agggcctgggtctgtactcctc

SEQ ID NO: 10055343 - DNA, 22 bp, Homo sapiens
agggcctgggatgtcctcctag

SEQ ID NO: 10055344 - DNA, 22 bp, Homo sapiens
agggcctgggccagcacccttt

SEQ ID NO: 10055345 - DNA, 23 bp, Homo sapiens
acataaacagaaggtgtgcttcc

SEQ ID NO: 10055346 - DNA, 22 bp, Homo sapiens
aggcaggcaagttcatatgagg

SEQ ID NO: 10055347 - DNA, 22 bp, Homo sapiens
aggcaggcaaccacctgggaag

SEQ ID NO: 10055348 - DNA, 22 bp, Homo sapiens
aggcaggcacacttcctccagg

SEQ ID NO: 10055349 - DNA, 22 bp, Homo sapiens
aggcagcatgggcccagagtcc

SEQ ID NO: 10055350 - DNA, 23 bp, Homo sapiens
acagttatagctgtgaataacat

SEQ ID NO: 10055351 - DNA, 22 bp, Homo sapiens
acagttcaagacatcagtatga

SEQ ID NO: 10055352 - DNA, 20 bp, Homo sapiens
aggagtccctgtgctctctc

SEQ ID NO: 10055353 - DNA, 21 bp, Homo sapiens
aggaggaacccgtggctgggc

SEQ ID NO: 10055354 - DNA, 23 bp, Homo sapiens
aggaggaaaagttatctgctgag

SEQ ID NO: 10055355 - DNA, 22 bp, Homo sapiens
acagggtggggatggtgagctt

SEQ ID NO: 10055356 - DNA, 22 bp, Homo sapiens
acaggtggcataggcagtttga

SEQ ID NO: 10055357 - DNA, 22 bp, Homo sapiens
acaggtggcagaagcatttact

SEQ ID NO: 10055358 - DNA, 22 bp, Homo sapiens
acaggtggtctttgctcctttt

SEQ ID NO: 10055359 - DNA, 22 bp, Homo sapiens
acaggtggtctttgctcctttt

SEQ ID NO: 10055360 - DNA, 18 bp, Homo sapiens
acaggctgtgggaatggt

SEQ ID NO: 10055361 - DNA, 22 bp, Homo sapiens
acaggctgccacttgcatccaa

SEQ ID NO: 10055362 - DNA, 22 bp, Homo sapiens
acagctgtgacttagagaagtt

SEQ ID NO: 10055363 - DNA, 22 bp, Homo sapiens
acagctgtgggctctgcatata

SEQ ID NO: 10055364 - DNA, 22 bp, Homo sapiens
acaggcctgggttcaaatttgg

SEQ ID NO: 10055365 - DNA, 22 bp, Homo sapiens
acaggcctggggtacaagttct

SEQ ID NO: 10055366 - DNA, 22 bp, Homo sapiens
acaggcctcaagacacccaggt

SEQ ID NO: 10055367 - DNA, 22 bp, Homo sapiens
acaggcctcccatccggagccc

SEQ ID NO: 10055368 - DNA, 22 bp, Homo sapiens
acagcctgcagccccaggtcgc

SEQ ID NO: 10055369 - DNA, 22 bp, Homo sapiens
acagctcagacatcactgctct

SEQ ID NO: 10055370 - DNA, 22 bp, Homo sapiens
acagctacatcaaactcagaag

SEQ ID NO: 10055371 - DNA, 22 bp, Homo sapiens
acagcctttaaccatttcttcc

SEQ ID NO: 10055372 - DNA, 22 bp, Homo sapiens
agctggggctgcagagaacagg

SEQ ID NO: 10055373 - DNA, 22 bp, Homo sapiens
atccagagtaatacagaatgca

SEQ ID NO: 10055374 - DNA, 22 bp, Homo sapiens
atcactatgggcattatattta

SEQ ID NO: 10055375 - DNA, 22 bp, Homo sapiens
atataatagtttcataaaggct

SEQ ID NO: 10055376 - DNA, 22 bp, Homo sapiens
atatacacatctttttaaatat

SEQ ID NO: 10055377 - DNA, 22 bp, Homo sapiens
actttggtttccctgttcgtaa

SEQ ID NO: 10055378 - DNA, 22 bp, Homo sapiens
actttggttataggagccaaaa

SEQ ID NO: 10055379 - DNA, 22 bp, Homo sapiens
actttggtgcgaagtcacttta

SEQ ID NO: 10055380 - DNA, 20 bp, Homo sapiens
actttggttattgggaccat

SEQ ID NO: 10055381 - DNA, 22 bp, Homo sapiens
actttggttcacagctgttcat

SEQ ID NO: 10055382 - DNA, 22 bp, Homo sapiens
atatacacatctttttaaatat

SEQ ID NO: 10055383 - DNA, 22 bp, Homo sapiens
actttggtcccatgtgtgtaaa

SEQ ID NO: 10055384 - DNA, 22 bp, Homo sapiens
actttggtctctgcccctggtg

SEQ ID NO: 10055385 - DNA, 17 bp, Homo sapiens
actttggtcctgtgctc

SEQ ID NO: 10055386 - DNA, 19 bp, Homo sapiens
actttggtgattagaggga

SEQ ID NO: 10055387 - DNA, 22 bp, Homo sapiens
actttggtgatacagatacggc

SEQ ID NO: 10055388 - DNA, 22 bp, Homo sapiens
actttggtgaatcagttttgtt

SEQ ID NO: 10055389 - DNA, 22 bp, Homo sapiens
actttggtcttagaggaggaat

SEQ ID NO: 10055390 - DNA, 22 bp, Homo sapiens
atatgaaaagaagtcaccattg

SEQ ID NO: 10055391 - DNA, 22 bp, Homo sapiens
agaaacaaggtgtaggttgacc

SEQ ID NO: 10055392 - DNA, 22 bp, Homo sapiens
agaaacagaaccaggtgtcatt

SEQ ID NO: 10055393 - DNA, 22 bp, Homo sapiens
atatatttgagaatattcatga

SEQ ID NO: 10055394 - DNA, 22 bp, Homo sapiens
acttcagagttagttatagacc

SEQ ID NO: 10055395 - DNA, 22 bp, Homo sapiens
actgtgtcctatttccttgaca

SEQ ID NO: 10055396 - DNA, 22 bp, Homo sapiens
actgttacagagcaggaaattg

SEQ ID NO: 10055397 - DNA, 22 bp, Homo sapiens
acttgccccagaattgctgctg

SEQ ID NO: 10055398 - DNA, 22 bp, Homo sapiens
acttcagccaagaaaactcagt

SEQ ID NO: 10055399 - DNA, 22 bp, Homo sapiens
acttccaaagaagtgattacag

SEQ ID NO: 10055400 - DNA, 22 bp, Homo sapiens
acttccaaaacacagcatggca

SEQ ID NO: 10055401 - DNA, 22 bp, Homo sapiens
acttccaaataccatcacattg

SEQ ID NO: 10055402 - DNA, 22 bp, Homo sapiens
acttccaacttcagtcctgagc

SEQ ID NO: 10055403 - DNA, 22 bp, Homo sapiens
acttccaagtgacattcatatc

SEQ ID NO: 10055404 - DNA, 17 bp, Homo sapiens
acttccaagcattgctg

SEQ ID NO: 10055405 - DNA, 22 bp, Homo sapiens
acttccaagtttattcatgtga

SEQ ID NO: 10055406 - DNA, 22 bp, Homo sapiens
actgtgccacaattcaccaggg

SEQ ID NO: 10055407 - DNA, 22 bp, Homo sapiens
actgtgtattcctatatagtaa

SEQ ID NO: 10055408 - DNA, 22 bp, Homo sapiens
actgtggtgcacggcctgctcc

SEQ ID NO: 10055409 - DNA, 22 bp, Homo sapiens
actgtcttgtgttaaagaacca

SEQ ID NO: 10055410 - DNA, 21 bp, Homo sapiens
acgggaatgaacatggtggag

SEQ ID NO: 10055411 - DNA, 21 bp, Homo sapiens
accttcagtgttctcagctgc

SEQ ID NO: 10055412 - DNA, 22 bp, Homo sapiens
accttcagacatcaactatctc

SEQ ID NO: 10055413 - DNA, 22 bp, Homo sapiens
acctgtttacctgcacctgttt

SEQ ID NO: 10055414 - DNA, 22 bp, Homo sapiens
actcaacagggaacaagatcag

SEQ ID NO: 10055415 - DNA, 22 bp, Homo sapiens
aggtactgaaaaaatgtttgca

SEQ ID NO: 10055416 - DNA, 22 bp, Homo sapiens
acctgtgttttccctcagtttc

SEQ ID NO: 10055417 - DNA, 20 bp, Homo sapiens
acctggagacagcactctgg

SEQ ID NO: 10055418 - DNA, 22 bp, Homo sapiens
acctggacacctgctgtcatct

SEQ ID NO: 10055419 - DNA, 22 bp, Homo sapiens
agggtgtgctgttgggtctttc

SEQ ID NO: 10055420 - DNA, 22 bp, Homo sapiens
agggtgtgttctcctatgagaa

SEQ ID NO: 10055421 - DNA, 22 bp, Homo sapiens
acctccccattaggtcacccac

SEQ ID NO: 10055422 - DNA, 22 bp, Homo sapiens
acctccccgggagcagcctcct

SEQ ID NO: 10055423 - DNA, 22 bp, Homo sapiens
agggctgtttttggcacctggg

SEQ ID NO: 10055424 - DNA, 22 bp, Homo sapiens
agtctacaacgcaagcaacatg

SEQ ID NO: 10055425 - DNA, 22 bp, Homo sapiens
actccagaatcctagggtcagc

SEQ ID NO: 10055426 - DNA, 22 bp, Homo sapiens
actccacatttgaacacagttc

SEQ ID NO: 10055427 - DNA, 22 bp, Homo sapiens
actccaaggccacatgcattcc

SEQ ID NO: 10055428 - DNA, 22 bp, Homo sapiens
agtctgggctgtctgcaggagt

SEQ ID NO: 10055429 - DNA, 22 bp, Homo sapiens
agtctgggtggctgagctacag

SEQ ID NO: 10055430 - DNA, 22 bp, Homo sapiens
agtctgggtgtgaatgaacttg

SEQ ID NO: 10055431 - DNA, 22 bp, Homo sapiens
actcttcattcaagtatgcaaa

SEQ ID NO: 10055432 - DNA, 22 bp, Homo sapiens
actcttcattcaagtatgcaaa

SEQ ID NO: 10055433 - DNA, 22 bp, Homo sapiens
actgaacaccatttataacatt

SEQ ID NO: 10055434 - DNA, 23 bp, Homo sapiens
actgctgtctttgaagtgcttga

SEQ ID NO: 10055435 - DNA, 22 bp, Homo sapiens
actgctgcaggtccagcccctt

SEQ ID NO: 10055436 - DNA, 22 bp, Homo sapiens
actgctgactaaacagctccat

SEQ ID NO: 10055437 - DNA, 22 bp, Homo sapiens
actgctttagacctagagctct

SEQ ID NO: 10055438 - DNA, 22 bp, Homo sapiens
actggatgaggggaaagagaca

SEQ ID NO: 10055439 - DNA, 22 bp, Homo sapiens
actgcctgtagctcttcatctc

SEQ ID NO: 10055440 - DNA, 22 bp, Homo sapiens
actgcaacctccgcctgccagg

SEQ ID NO: 10055441 - DNA, 23 bp, Homo sapiens
actgattcttgaagttgacaagt

SEQ ID NO: 10055442 - DNA, 22 bp, Homo sapiens
actgaataatggtctgtgatct

SEQ ID NO: 10055443 - DNA, 22 bp, Homo sapiens
actgaatagtgctgcattgtac

SEQ ID NO: 10055444 - DNA, 22 bp, Homo sapiens
actgaatatattccattgcatg

SEQ ID NO: 10055445 - DNA, 22 bp, Homo sapiens
aagaggggtggtctgtgaggat

SEQ ID NO: 10055446 - DNA, 22 bp, Homo sapiens
aaatacgtgcacatacatacat

SEQ ID NO: 10055447 - DNA, 22 bp, Homo sapiens
aaatactagaattcagagttga

SEQ ID NO: 10055448 - DNA, 22 bp, Homo sapiens
aaatacatttacagtcgtggct

SEQ ID NO: 10055449 - DNA, 22 bp, Homo sapiens
aaatacattagacggagagtta

SEQ ID NO: 10055450 - DNA, 22 bp, Homo sapiens
aaatactattgaccaggtctct

SEQ ID NO: 10055451 - DNA, 22 bp, Homo sapiens
aagagggaggtgcgggtgcaga

SEQ ID NO: 10055452 - DNA, 22 bp, Homo sapiens
aagacagagggaagcaatgatg

SEQ ID NO: 10055453 - DNA, 22 bp, Homo sapiens
aaagtgcacctgcttcttcttg

SEQ ID NO: 10055454 - DNA, 22 bp, Homo sapiens
aagacctaaaattccctcagat

SEQ ID NO: 10055455 - DNA, 22 bp, Homo sapiens
aagacagatgcaacctgctagc

SEQ ID NO: 10055456 - DNA, 22 bp, Homo sapiens
aagactcaaggaacaacacagt

SEQ ID NO: 10055457 - DNA, 22 bp, Homo sapiens
aagactacttttggcagtgtgt

SEQ ID NO: 10055458 - DNA, 22 bp, Homo sapiens
aagcagcatatgacagcatcca

SEQ ID NO: 10055459 - DNA, 22 bp, Homo sapiens
aagatcaagtgtactttatgta

SEQ ID NO: 10055460 - DNA, 14 bp, Homo sapiens
aagatcaccttcct

SEQ ID NO: 10055461 - DNA, 22 bp, Homo sapiens
aagatccatgggaatgtttggc

SEQ ID NO: 10055462 - DNA, 23 bp, Homo sapiens
aagatccattcaaattatgtatc

SEQ ID NO: 10055463 - DNA, 22 bp, Homo sapiens
aagcccttttcaagatacaaca

SEQ ID NO: 10055464 - DNA, 22 bp, Homo sapiens
aagcctgctttgttccacagca

SEQ ID NO: 10055465 - DNA, 22 bp, Homo sapiens
aagcctctggggcctcatctgt

SEQ ID NO: 10055466 - DNA, 22 bp, Homo sapiens
aagcccagatgggagcatttca

SEQ ID NO: 10055467 - DNA, 22 bp, Homo sapiens
aaaggcagtgggtatgtggatc

SEQ ID NO: 10055468 - DNA, 21 bp, Homo sapiens
aactgcaaatcttagactgca

SEQ ID NO: 10055469 - DNA, 22 bp, Homo sapiens
aaagcctcccaggttatgagta

SEQ ID NO: 10055470 - DNA, 22 bp, Homo sapiens
aaagtaaagattgggaatgtgt

SEQ ID NO: 10055471 - DNA, 22 bp, Homo sapiens
aagaacagttgggaggtgagcc

SEQ ID NO: 10055472 - DNA, 22 bp, Homo sapiens
aagaacagttgggaggtgagcc

SEQ ID NO: 10055473 - DNA, 22 bp, Homo sapiens
aactgtacgataataaatttgt

SEQ ID NO: 10055474 - DNA, 22 bp, Homo sapiens
aactgtcatctttcaaggaaga

SEQ ID NO: 10055475 - DNA, 22 bp, Homo sapiens
aactgtgaggatgtgcaaattc

SEQ ID NO: 10055476 - DNA, 22 bp, Homo sapiens
aacacattggaagccaagaatg

SEQ ID NO: 10055477 - DNA, 22 bp, Homo sapiens
aacactgtcttatacttcaatg

SEQ ID NO: 10055478 - DNA, 22 bp, Homo sapiens
aaagatgttttataagttatgg

SEQ ID NO: 10055479 - DNA, 22 bp, Homo sapiens
aacataaatttgaagtggcaaa

SEQ ID NO: 10055480 - DNA, 22 bp, Homo sapiens
aacagtgagttgatgactgaat

SEQ ID NO: 10055481 - DNA, 22 bp, Homo sapiens
aaagcactgcacatatatttgc

SEQ ID NO: 10055482 - DNA, 22 bp, Homo sapiens
aaagcacttcaggagcagtttg

SEQ ID NO: 10055483 - DNA, 22 bp, Homo sapiens
aaagccattgaactgtacttta

SEQ ID NO: 10055484 - DNA, 22 bp, Homo sapiens
aacatacttatactaaataatg

SEQ ID NO: 10055485 - DNA, 22 bp, Homo sapiens
aaactgtgaagcaagtacaagg

SEQ ID NO: 10055486 - DNA, 22 bp, Homo sapiens
aaatagttcagcttgtaaaccc

SEQ ID NO: 10055487 - DNA, 22 bp, Homo sapiens
aaagaaacctatcagccacatg

SEQ ID NO: 10055488 - DNA, 22 bp, Homo sapiens
aaagatcagtctgaagcaacat

SEQ ID NO: 10055489 - DNA, 23 bp, Homo sapiens
aaagagactgatacggaagttcc

SEQ ID NO: 10055490 - DNA, 22 bp, Homo sapiens
aaagagcaagctgagatttgaa

SEQ ID NO: 10055491 - DNA, 22 bp, Homo sapiens
aaagagaaacttagaagcctga

SEQ ID NO: 10055492 - DNA, 20 bp, Homo sapiens
aaagagaagcctcaccttgt

SEQ ID NO: 10055493 - DNA, 22 bp, Homo sapiens
aaagactagcatttatatgtac

SEQ ID NO: 10055494 - DNA, 22 bp, Homo sapiens
aaagactcaattgttccctaat

SEQ ID NO: 10055495 - DNA, 22 bp, Homo sapiens
aaagaacaatgtggaatctcct

SEQ ID NO: 10055496 - DNA, 22 bp, Homo sapiens
aaagaacagatgtgtggtgcat

SEQ ID NO: 10055497 - DNA, 22 bp, Homo sapiens
aaagaacaatgtggaatctcct

SEQ ID NO: 10055498 - DNA, 22 bp, Homo sapiens
aaagaacaaattagctgtttta

SEQ ID NO: 10055499 - DNA, 22 bp, Homo sapiens
aaagaacaaattagctgtttta

SEQ ID NO: 10055500 - DNA, 22 bp, Homo sapiens
aaagaacaaatgatatatggtt

SEQ ID NO: 10055501 - DNA, 22 bp, Homo sapiens
aaacattcaaagcaggatgtgt

SEQ ID NO: 10055502 - DNA, 22 bp, Homo sapiens
aaacatgtaattctgcttaaga

SEQ ID NO: 10055503 - DNA, 22 bp, Homo sapiens
aaactgtatatttatggcatgt

SEQ ID NO: 10055504 - DNA, 22 bp, Homo sapiens
aaactgtaagagaataaactac

SEQ ID NO: 10055505 - DNA, 22 bp, Homo sapiens
aaactgtatagggaaaagtaga

SEQ ID NO: 10055506 - DNA, 22 bp, Homo sapiens
aaacagctcaagaagttactct

SEQ ID NO: 10055507 - DNA, 22 bp, Homo sapiens
aaacagctggtctcaaatgttc

SEQ ID NO: 10055508 - DNA, 22 bp, Homo sapiens
aaacagctaagtacattcaagg

SEQ ID NO: 10055509 - DNA, 22 bp, Homo sapiens
aaacactgtgggacatcttact

SEQ ID NO: 10055510 - DNA, 22 bp, Homo sapiens
aaagccactgcatgtgtagtat

SEQ ID NO: 10055511 - DNA, 22 bp, Homo sapiens
aaaactcctgaaattgtttccc

SEQ ID NO: 10055512 - DNA, 22 bp, Homo sapiens
aaaacctgattgaattctattt

SEQ ID NO: 10055513 - DNA, 22 bp, Homo sapiens
aaaaccttcaggtttggagttt

SEQ ID NO: 10055514 - DNA, 22 bp, Homo sapiens
aaaacataaactgacagcccat

SEQ ID NO: 10055515 - DNA, 22 bp, Homo sapiens
aaaaggcatggaggttgatagt

SEQ ID NO: 10055516 - DNA, 18 bp, Homo sapiens
aaaaagtgctcaggccta

SEQ ID NO: 10055517 - DNA, 22 bp, Homo sapiens
aaaaagtattggccatggttga

SEQ ID NO: 10055518 - DNA, 21 bp, Homo sapiens
aaaaggaggcaggtgaacagc

SEQ ID NO: 10055519 - DNA, 22 bp, Homo sapiens
aaaaatacttcacttctgggtg

SEQ ID NO: 10055520 - DNA, 21 bp, Homo sapiens
aaaaagctggggcatgcatgc

SEQ ID NO: 10055521 - DNA, 22 bp, Homo sapiens
aaaattactattgttcctgggc

SEQ ID NO: 10055522 - DNA, 22 bp, Homo sapiens
aaaactgtatcttcttgggact

SEQ ID NO: 10055523 - DNA, 22 bp, Homo sapiens
aaactgggattcttcacaaggt

SEQ ID NO: 10055524 - DNA, 17 bp, Homo sapiens
aaactggggtcaggagc

SEQ ID NO: 10055525 - DNA, 22 bp, Homo sapiens
aaacagtactcgatttttgtag

SEQ ID NO: 10055526 - DNA, 22 bp, Homo sapiens
aaacaggcgcttactaagaaaa

SEQ ID NO: 10055527 - DNA, 22 bp, Homo sapiens
aaacaggcttccattagagcaa

SEQ ID NO: 10055528 - DNA, 22 bp, Homo sapiens
aaacaggcttgcaacatgtttt

SEQ ID NO: 10055529 - DNA, 22 bp, Homo sapiens
aaacaggcatcactcagcaaag

SEQ ID NO: 10055530 - DNA, 22 bp, Homo sapiens
aaaatactgtggagtgttgaaa

SEQ ID NO: 10055531 - DNA, 22 bp, Homo sapiens
aaaatatggggtgagcccagag

SEQ ID NO: 10055532 - DNA, 22 bp, Homo sapiens
aaaatatgactgtgctccttaa

SEQ ID NO: 10055533 - DNA, 22 bp, Homo sapiens
aaaatatgaagttgtcagtatg

SEQ ID NO: 10055534 - DNA, 22 bp, Homo sapiens
aaagagctgggacttaaagtgc

SEQ ID NO: 10055535 - DNA, 22 bp, Homo sapiens
aaagagctcacagtccactgga

SEQ ID NO: 10055536 - DNA, 22 bp, Homo sapiens
aaacaccagcactgtttacaaa

SEQ ID NO: 10055537 - DNA, 21 bp, Homo sapiens
aaagagcccgctgagaggttc

SEQ ID NO: 10055538 - DNA, 22 bp, Homo sapiens
aacctcaaactcttgggcttaa

SEQ ID NO: 10055539 - DNA, 22 bp, Homo sapiens
aaccttcttgtgcagaactgta

SEQ ID NO: 10055540 - DNA, 22 bp, Homo sapiens
aatgaacaacactgaaggaaga

SEQ ID NO: 10055541 - DNA, 22 bp, Homo sapiens
aactagaaagaacatatttcca

SEQ ID NO: 10055542 - DNA, 22 bp, Homo sapiens
aatgacaaccacaatggtgctg

SEQ ID NO: 10055543 - DNA, 22 bp, Homo sapiens
aatgacaagacatagtctctga

SEQ ID NO: 10055544 - DNA, 22 bp, Homo sapiens
aatgacaatggcagaggtagaa

SEQ ID NO: 10055545 - DNA, 22 bp, Homo sapiens
aatggcttagcagagttagaag

SEQ ID NO: 10055546 - DNA, 22 bp, Homo sapiens
aatggctttaagtagtctcaca

SEQ ID NO: 10055547 - DNA, 22 bp, Homo sapiens
aactagcagctaagacataatt

SEQ ID NO: 10055548 - DNA, 22 bp, Homo sapiens
aatggccagcaacaggagtgaa

SEQ ID NO: 10055549 - DNA, 22 bp, Homo sapiens
aatagatactacttagatgtag

SEQ ID NO: 10055550 - DNA, 22 bp, Homo sapiens
aacatgtatcgctttttaatat

SEQ ID NO: 10055551 - DNA, 22 bp, Homo sapiens
aacatgtaaccagcattcatct

SEQ ID NO: 10055552 - DNA, 22 bp, Homo sapiens
aacatgaaaagcccagagaggt

SEQ ID NO: 10055553 - DNA, 22 bp, Homo sapiens
aatagacaagcaccctggtaaa

SEQ ID NO: 10055554 - DNA, 22 bp, Homo sapiens
aatagaatttgtactgtgtttt

SEQ ID NO: 10055555 - DNA, 22 bp, Homo sapiens
aacatccccagcgtctcctagg

SEQ ID NO: 10055556 - DNA, 22 bp, Homo sapiens
aacagctagtaccaatccacta

SEQ ID NO: 10055557 - DNA, 22 bp, Homo sapiens
aacagctgcaaaaggttgcctg

SEQ ID NO: 10055558 - DNA, 22 bp, Homo sapiens
aaattattttcagaatggagaa

SEQ ID NO: 10055559 - DNA, 22 bp, Homo sapiens
aaatgtcaaggtgatagatgca

SEQ ID NO: 10055560 - DNA, 22 bp, Homo sapiens
aaatgtcagaagctttacttct

SEQ ID NO: 10055561 - DNA, 22 bp, Homo sapiens
aaatgtcagaggaacatattga

SEQ ID NO: 10055562 - DNA, 22 bp, Homo sapiens
aaatgtccttagagaaaagtca

SEQ ID NO: 10055563 - DNA, 22 bp, Homo sapiens
aaatgtccattgaatggatgag

SEQ ID NO: 10055564 - DNA, 22 bp, Homo sapiens
aaatgtcctgagattcaactta

SEQ ID NO: 10055565 - DNA, 22 bp, Homo sapiens
aaatgtcatatttaagtaggaa

SEQ ID NO: 10055566 - DNA, 22 bp, Homo sapiens
aacaatgtgaagtgctgttcag

SEQ ID NO: 10055567 - DNA, 22 bp, Homo sapiens
aacacagaagtgccaagagcca

SEQ ID NO: 10055568 - DNA, 23 bp, Homo sapiens
aacacaaagctgattccagtggc

SEQ ID NO: 10055569 - DNA, 20 bp, Homo sapiens
aacacactggtggcatcagg

SEQ ID NO: 10055570 - DNA, 22 bp, Homo sapiens
aacacagacatagtgattacag

SEQ ID NO: 10055571 - DNA, 22 bp, Homo sapiens
aacacagagtatttgaagcatt

SEQ ID NO: 10055572 - DNA, 22 bp, Homo sapiens
aacacagagtatttgaagcatt

SEQ ID NO: 10055573 - DNA, 20 bp, Homo sapiens
aacacagataccaaaggttg

SEQ ID NO: 10055574 - DNA, 22 bp, Homo sapiens
aacacagatcaaaatatttcct

SEQ ID NO: 10055575 - DNA, 20 bp, Homo sapiens
aacacagataccaaaggttg

SEQ ID NO: 10055576 - DNA, 22 bp, Homo sapiens
aacacagctaatttctgtcaat

SEQ ID NO: 10055577 - DNA, 22 bp, Homo sapiens
aacagaatagttgatgtacagt

SEQ ID NO: 10055578 - DNA, 22 bp, Homo sapiens
aacagaacccgagtgtgaatct

SEQ ID NO: 10055579 - DNA, 22 bp, Homo sapiens
aacagacaactcctgtggctca

SEQ ID NO: 10055580 - DNA, 22 bp, Homo sapiens
aacagacttagagcatcccaat

SEQ ID NO: 10055581 - DNA, 22 bp, Homo sapiens
aacagagatcttaattcctgta

SEQ ID NO: 10055582 - DNA, 22 bp, Homo sapiens
aacagacatatttttaatatgc

SEQ ID NO: 10055583 - DNA, 22 bp, Homo sapiens
aatttccaaatttctgtcacac

SEQ ID NO: 10055584 - DNA, 22 bp, Homo sapiens
aatttccagatcagatgactca

SEQ ID NO: 10055585 - DNA, 22 bp, Homo sapiens
aattttatctctaagcaggctt

SEQ ID NO: 10055586 - DNA, 20 bp, Homo sapiens
aattttatctccatcctttg

SEQ ID NO: 10055587 - DNA, 20 bp, Homo sapiens
aagagaagaagtctttgaaa

SEQ ID NO: 10055588 - DNA, 22 bp, Homo sapiens
aagagaagaaagtgtctacaca

SEQ ID NO: 10055589 - DNA, 22 bp, Homo sapiens
aagagacaagaattccaacgct

SEQ ID NO: 10055590 - DNA, 22 bp, Homo sapiens
aagagacagagccatgtttcta

SEQ ID NO: 10055591 - DNA, 21 bp, Homo sapiens
aagagacatttctcatcagca

SEQ ID NO: 10055592 - DNA, 21 bp, Homo sapiens
aagagacatttctcatcagca

SEQ ID NO: 10055593 - DNA, 22 bp, Homo sapiens
acacaaaatcaaagtcctaggc

SEQ ID NO: 10055594 - DNA, 22 bp, Homo sapiens
aagagacttctagatttgttga

SEQ ID NO: 10055595 - DNA, 22 bp, Homo sapiens
acacaaacagtctatagcacca

SEQ ID NO: 10055596 - DNA, 22 bp, Homo sapiens
acacaaacagtctatagcacca

SEQ ID NO: 10055597 - DNA, 22 bp, Homo sapiens
acacaaactgctagaaaattgg

SEQ ID NO: 10055598 - DNA, 22 bp, Homo sapiens
aattctaaatgtaatttagaat

SEQ ID NO: 10055599 - DNA, 22 bp, Homo sapiens
aagaacaactgctttaaaagca

SEQ ID NO: 10055600 - DNA, 22 bp, Homo sapiens
aatggctttgacattttcaaat

SEQ ID NO: 10055601 - DNA, 22 bp, Homo sapiens
aactggaagagtgaatataact

SEQ ID NO: 10055602 - DNA, 22 bp, Homo sapiens
aagaaaacaatgacttgccagc

SEQ ID NO: 10055603 - DNA, 22 bp, Homo sapiens
aactggagggcaaatggcttgt

SEQ ID NO: 10055604 - DNA, 22 bp, Homo sapiens
aagaaaacaatgacttgccagc

SEQ ID NO: 10055605 - DNA, 22 bp, Homo sapiens
aagaaaacatgatctaatttaa

SEQ ID NO: 10055606 - DNA, 22 bp, Homo sapiens
acagcctgctgcctgcttcttg

SEQ ID NO: 10055607 - DNA, 22 bp, Homo sapiens
acagccagggcattgtcgccga

SEQ ID NO: 10055608 - DNA, 22 bp, Homo sapiens
acagccagggcattgtcgccga

SEQ ID NO: 10055609 - DNA, 22 bp, Homo sapiens
acagccagggacatacaatggt

SEQ ID NO: 10055610 - DNA, 22 bp, Homo sapiens
acagcagagaactttagagggt

SEQ ID NO: 10055611 - DNA, 22 bp, Homo sapiens
acagcagagacactcaggaggc

SEQ ID NO: 10055612 - DNA, 22 bp, Homo sapiens
acagcagagccagtggctctag

SEQ ID NO: 10055613 - DNA, 22 bp, Homo sapiens
acagcagaccccagtgccatgg

SEQ ID NO: 10055614 - DNA, 20 bp, Homo sapiens
aagcagaagctgctctcagc

SEQ ID NO: 10055615 - DNA, 22 bp, Homo sapiens
aagcagaaggggaataatattt

SEQ ID NO: 10055616 - DNA, 22 bp, Homo sapiens
aagcagaatttcccactagttg

SEQ ID NO: 10055617 - DNA, 22 bp, Homo sapiens
aagcaatagcaacaactttaca

SEQ ID NO: 10055618 - DNA, 22 bp, Homo sapiens
aagcaatagggtaatctactca

SEQ ID NO: 10055619 - DNA, 22 bp, Homo sapiens
aagcaatatactgatatgatta

SEQ ID NO: 10055620 - DNA, 20 bp, Homo sapiens
aagcaatatagtgcaaatgt

SEQ ID NO: 10055621 - DNA, 22 bp, Homo sapiens
aagcaattggttttagtaaaat

SEQ ID NO: 10055622 - DNA, 22 bp, Homo sapiens
aagcaatttgacagtacatatc

SEQ ID NO: 10055623 - DNA, 22 bp, Homo sapiens
aagcacaatttaggactgaaat

SEQ ID NO: 10055624 - DNA, 21 bp, Homo sapiens
acacattatgagcatagactc

SEQ ID NO: 10055625 - DNA, 22 bp, Homo sapiens
aagatcctgtactttcctcact

SEQ ID NO: 10055626 - DNA, 22 bp, Homo sapiens
aagagcaggacagaatcagaac

SEQ ID NO: 10055627 - DNA, 22 bp, Homo sapiens
acacatgcaggtatacatgttc

SEQ ID NO: 10055628 - DNA, 22 bp, Homo sapiens
acacatgcaggtatacatgttc

SEQ ID NO: 10055629 - DNA, 22 bp, Homo sapiens
aagcaaagagataaccttttgg

SEQ ID NO: 10055630 - DNA, 22 bp, Homo sapiens
aagatgcggttgaccatggtgt

SEQ ID NO: 10055631 - DNA, 22 bp, Homo sapiens
aagatgcagcttccacttttgc

SEQ ID NO: 10055632 - DNA, 22 bp, Homo sapiens
acagtctttaatttctttgtgg

SEQ ID NO: 10055633 - DNA, 22 bp, Homo sapiens
acagtcttgagcatcagccaga

SEQ ID NO: 10055634 - DNA, 22 bp, Homo sapiens
aaggaggaataaagaggtggtg

SEQ ID NO: 10055635 - DNA, 22 bp, Homo sapiens
aagctggactctgccatttact

SEQ ID NO: 10055636 - DNA, 22 bp, Homo sapiens
acatatctgttagacacagcag

SEQ ID NO: 10055637 - DNA, 22 bp, Homo sapiens
aaggaggcagaactcacatgga

SEQ ID NO: 10055638 - DNA, 22 bp, Homo sapiens
aaggaggagcggaggcttgttg

SEQ ID NO: 10055639 - DNA, 22 bp, Homo sapiens
acatatgcgatcataggatgca

SEQ ID NO: 10055640 - DNA, 22 bp, Homo sapiens
aaggcagagggctggatcagag

SEQ ID NO: 10055641 - DNA, 22 bp, Homo sapiens
acagcctggactggctctctgc

SEQ ID NO: 10055642 - DNA, 22 bp, Homo sapiens
acagcctgtgtaccagctggga

SEQ ID NO: 10055643 - DNA, 22 bp, Homo sapiens
aagcattttagataaagcatca

SEQ ID NO: 10055644 - DNA, 22 bp, Homo sapiens
aagcatttgtgaaattcagatg

SEQ ID NO: 10055645 - DNA, 22 bp, Homo sapiens
aagcattttgccacttgaagtt

SEQ ID NO: 10055646 - DNA, 22 bp, Homo sapiens
aagcattttgttttaagaatga

SEQ ID NO: 10055647 - DNA, 22 bp, Homo sapiens
aagctcattaattagaagctaa

SEQ ID NO: 10055648 - DNA, 22 bp, Homo sapiens
aagctggaacatcttgaggaag

SEQ ID NO: 10055649 - DNA, 19 bp, Homo sapiens
acatttaaattcagatctc

SEQ ID NO: 10055650 - DNA, 22 bp, Homo sapiens
acatttaaatatgccttatatt

SEQ ID NO: 10055651 - DNA, 22 bp, Homo sapiens
acatttctggagtttctcaaca

SEQ ID NO: 10055652 - DNA, 22 bp, Homo sapiens
aaggctcggcaatgtgcggctc

SEQ ID NO: 10055653 - DNA, 22 bp, Homo sapiens
aaggctcggcaatgtgcggctc

SEQ ID NO: 10055654 - DNA, 22 bp, Homo sapiens
acccagagcccttagcacagac

SEQ ID NO: 10055655 - DNA, 19 bp, Homo sapiens
accaggcttatggtcagtg

SEQ ID NO: 10055656 - DNA, 22 bp, Homo sapiens
acccagagtcatggcacttagc

SEQ ID NO: 10055657 - DNA, 22 bp, Homo sapiens
acccagagtcagacagccatgg

SEQ ID NO: 10055658 - DNA, 22 bp, Homo sapiens
acccagaggcggaggttgcagt

SEQ ID NO: 10055659 - DNA, 22 bp, Homo sapiens
acccagaggtgtctagcaagct

SEQ ID NO: 10055660 - DNA, 22 bp, Homo sapiens
acccaggatgataatgttcaca

SEQ ID NO: 10055661 - DNA, 22 bp, Homo sapiens
agaacaatgttaaattattaag

SEQ ID NO: 10055662 - DNA, 22 bp, Homo sapiens
agaacaaaattagaggagtgca

SEQ ID NO: 10055663 - DNA, 22 bp, Homo sapiens
aatgcaaacagcccagaatcca

SEQ ID NO: 10055664 - DNA, 22 bp, Homo sapiens
aatcagaatttattgaatcttt

SEQ ID NO: 10055665 - DNA, 22 bp, Homo sapiens
aatcagaaattgagggtctggt

SEQ ID NO: 10055666 - DNA, 22 bp, Homo sapiens
aatcagaacttctcagggtggg

SEQ ID NO: 10055667 - DNA, 22 bp, Homo sapiens
aatcagaaagatcttgatgaga

SEQ ID NO: 10055668 - DNA, 19 bp, Homo sapiens
aatcagaaatatcgaggcc

SEQ ID NO: 10055669 - DNA, 22 bp, Homo sapiens
actttatttcctattgcatcca

SEQ ID NO: 10055670 - DNA, 22 bp, Homo sapiens
actttaaaactgatcatcagag

SEQ ID NO: 10055671 - DNA, 22 bp, Homo sapiens
actgttctgcatgctgtgaggg

SEQ ID NO: 10055672 - DNA, 19 bp, Homo sapiens
actgttctaacttgcagct

SEQ ID NO: 10055673 - DNA, 23 bp, Homo sapiens
actttattgaccccaggtcagtt

SEQ ID NO: 10055674 - DNA, 22 bp, Homo sapiens
actgttcacagattagtcgatg

SEQ ID NO: 10055675 - DNA, 22 bp, Homo sapiens
actgttcaagcaaatgacattg

SEQ ID NO: 10055676 - DNA, 21 bp, Homo sapiens
actgttcatttgatgaactgg

SEQ ID NO: 10055677 - DNA, 22 bp, Homo sapiens
actgttcatctcttagaaagta

SEQ ID NO: 10055678 - DNA, 21 bp, Homo sapiens
actgttcatctgttcagaagc

SEQ ID NO: 10055679 - DNA, 22 bp, Homo sapiens
actgttcatattcttagaaatt

SEQ ID NO: 10055680 - DNA, 22 bp, Homo sapiens
actgttcacccagcactagcag

SEQ ID NO: 10055681 - DNA, 22 bp, Homo sapiens
actgttcatctcttagaaagta

SEQ ID NO: 10055682 - DNA, 22 bp, Homo sapiens
actgttcatattcttagaaatt

SEQ ID NO: 10055683 - DNA, 22 bp, Homo sapiens
actgttcatcctttttgaacaa

SEQ ID NO: 10055684 - DNA, 22 bp, Homo sapiens
aatataattttattcctagagt

SEQ ID NO: 10055685 - DNA, 22 bp, Homo sapiens
aatactagttattaaagctttt

SEQ ID NO: 10055686 - DNA, 22 bp, Homo sapiens
actgggctgcctggttcttcta

SEQ ID NO: 10055687 - DNA, 22 bp, Homo sapiens
aatactatgtagccaaaataat

SEQ ID NO: 10055688 - DNA, 22 bp, Homo sapiens
actgggctggggctcattctcc

SEQ ID NO: 10055689 - DNA, 22 bp, Homo sapiens
actgcactccagcccgagcaac

SEQ ID NO: 10055690 - DNA, 20 bp, Homo sapiens
actggagccatctcagccta

SEQ ID NO: 10055691 - DNA, 22 bp, Homo sapiens
aataccatgcagaaataacata

SEQ ID NO: 10055692 - DNA, 22 bp, Homo sapiens
aatacagaggaaacatttaata

SEQ ID NO: 10055693 - DNA, 22 bp, Homo sapiens
aagtcctttccagtcctgtgat

SEQ ID NO: 10055694 - DNA, 20 bp, Homo sapiens
acgtggccaccagtggctta

SEQ ID NO: 10055695 - DNA, 20 bp, Homo sapiens
acgtggccaccagtggctta

SEQ ID NO: 10055696 - DNA, 22 bp, Homo sapiens
aagtctctcatggctgacagca

SEQ ID NO: 10055697 - DNA, 22 bp, Homo sapiens
acggtgctgggtattggggttc

SEQ ID NO: 10055698 - DNA, 22 bp, Homo sapiens
acgtaatataagaaagtgtggt

SEQ ID NO: 10055699 - DNA, 22 bp, Homo sapiens
acctagaatgaagcaatgctgt

SEQ ID NO: 10055700 - DNA, 22 bp, Homo sapiens
acctagaaactgacagaatatt

SEQ ID NO: 10055701 - DNA, 23 bp, Homo sapiens
actcagagaccccgggaagtgac

SEQ ID NO: 10055702 - DNA, 22 bp, Homo sapiens
actccctccaaatctgcacagt

SEQ ID NO: 10055703 - DNA, 19 bp, Homo sapiens
actctacagtgtgtacaac

SEQ ID NO: 10055704 - DNA, 22 bp, Homo sapiens
actataacctgttagaatagat

SEQ ID NO: 10055705 - DNA, 22 bp, Homo sapiens
actcagaagatataatgactca

SEQ ID NO: 10055706 - DNA, 22 bp, Homo sapiens
actcactgcactttgaaatgtg

SEQ ID NO: 10055707 - DNA, 22 bp, Homo sapiens
aattgagtgcagccagcccagt

SEQ ID NO: 10055708 - DNA, 19 bp, Homo sapiens
aattctgtttcagcagatc

SEQ ID NO: 10055709 - DNA, 22 bp, Homo sapiens
aattctgtgcaggcagagctat

SEQ ID NO: 10055710 - DNA, 22 bp, Homo sapiens
aattgacaaatcatacttgtat

SEQ ID NO: 10055711 - DNA, 22 bp, Homo sapiens
aattgacaaatcatacttgtat

SEQ ID NO: 10055712 - DNA, 22 bp, Homo sapiens
aattgcttgtttctttaactga

SEQ ID NO: 10055713 - DNA, 22 bp, Homo sapiens
aattgcttatcttgttgaatag

SEQ ID NO: 10055714 - DNA, 22 bp, Homo sapiens
agaggctgaatgatgtcatcat

SEQ ID NO: 10055715 - DNA, 22 bp, Homo sapiens
agagggggaaaatagaggtgtt

SEQ ID NO: 10055716 - DNA, 22 bp, Homo sapiens
agagggggcagcggaccagtga

SEQ ID NO: 10055717 - DNA, 22 bp, Homo sapiens
agagggggtgtcagcactgcag

SEQ ID NO: 10055718 - DNA, 22 bp, Homo sapiens
agagggggtgttccagaagcat

SEQ ID NO: 10055719 - DNA, 22 bp, Homo sapiens
acaaagggggactgcagagggt

SEQ ID NO: 10055720 - DNA, 22 bp, Homo sapiens
acaaaggcatagtgaatgtttt

SEQ ID NO: 10055721 - DNA, 22 bp, Homo sapiens
acaaaggcaggattgacttagt

SEQ ID NO: 10055722 - DNA, 20 bp, Homo sapiens
agaggcttccttgggaggag

SEQ ID NO: 10055723 - DNA, 22 bp, Homo sapiens
acaaaggcagccaatcatctgc

SEQ ID NO: 10055724 - DNA, 22 bp, Homo sapiens
acaaaggcagagaattcaacat

SEQ ID NO: 10055725 - DNA, 22 bp, Homo sapiens
acaagcgggccacagtgctggt

SEQ ID NO: 10055726 - DNA, 22 bp, Homo sapiens
acaatgattttttagagtagtt

SEQ ID NO: 10055727 - DNA, 22 bp, Homo sapiens
acaacaatctaccctagcttct

SEQ ID NO: 10055728 - DNA, 22 bp, Homo sapiens
acaacaatctaccctagcttct

SEQ ID NO: 10055729 - DNA, 22 bp, Homo sapiens
agaggggttaagtgctagtccg

SEQ ID NO: 10055730 - DNA, 19 bp, Homo sapiens
acaaattggcaaaatgcaa

SEQ ID NO: 10055731 - DNA, 20 bp, Homo sapiens
acaacaaacttgcttaagga

SEQ ID NO: 10055732 - DNA, 22 bp, Homo sapiens
agataactggtttacattattg

SEQ ID NO: 10055733 - DNA, 22 bp, Homo sapiens
acaagaattatttctagttaac

SEQ ID NO: 10055734 - DNA, 22 bp, Homo sapiens
acaagataaggtgtcagtgtgt

SEQ ID NO: 10055735 - DNA, 22 bp, Homo sapiens
agaccctctcctcatggacatg

SEQ ID NO: 10055736 - DNA, 22 bp, Homo sapiens
agaccccatacctcagcaggta

SEQ ID NO: 10055737 - DNA, 22 bp, Homo sapiens
agagacaggagttctgtttcca

SEQ ID NO: 10055738 - DNA, 18 bp, Homo sapiens
agagacagcagcaaaaga

SEQ ID NO: 10055739 - DNA, 22 bp, Homo sapiens
agagacaggaatggcattaaga

SEQ ID NO: 10055740 - DNA, 22 bp, Homo sapiens
aattaacagagggcttattact

SEQ ID NO: 10055741 - DNA, 22 bp, Homo sapiens
aattaacaaatgtagctgtgat

SEQ ID NO: 10055742 - DNA, 22 bp, Homo sapiens
agagccaggctctacctgggtt

SEQ ID NO: 10055743 - DNA, 22 bp, Homo sapiens
agagccaggctcccatggggca

SEQ ID NO: 10055744 - DNA, 22 bp, Homo sapiens
agagccaggtgctgctgtttga

SEQ ID NO: 10055745 - DNA, 22 bp, Homo sapiens
agagacaggatatctgctcatg

SEQ ID NO: 10055746 - DNA, 22 bp, Homo sapiens
agagacagggttttgccatgtt

SEQ ID NO: 10055747 - DNA, 22 bp, Homo sapiens
agagccaggcggctgggcacct

SEQ ID NO: 10055748 - DNA, 22 bp, Homo sapiens
agagcctggaggttctgctgaa

SEQ ID NO: 10055749 - DNA, 22 bp, Homo sapiens
agagcctggacttttctgagcc

SEQ ID NO: 10055750 - DNA, 22 bp, Homo sapiens
agagcctggacctgggctctga

SEQ ID NO: 10055751 - DNA, 22 bp, Homo sapiens
agagccagttacaactgtggag

SEQ ID NO: 10055752 - DNA, 22 bp, Homo sapiens
agagcctgcatcaggcttgggg

SEQ ID NO: 10055753 - DNA, 20 bp, Homo sapiens
agagcctggaaaaagacatc

SEQ ID NO: 10055754 - DNA, 22 bp, Homo sapiens
agagcctgctacctcattccag

SEQ ID NO: 10055755 - DNA, 23 bp, Homo sapiens
agacaaaagcctcagtcttaggc

SEQ ID NO: 10055756 - DNA, 23 bp, Homo sapiens
agaagcagcttctggagtatcgg

SEQ ID NO: 10055757 - DNA, 20 bp, Homo sapiens
agacaaaatgacttcatgca

SEQ ID NO: 10055758 - DNA, 21 bp, Homo sapiens
agacaatgctgtaaaattcag

SEQ ID NO: 10055759 - DNA, 22 bp, Homo sapiens
agacaatggagggaaatacttc

SEQ ID NO: 10055760 - DNA, 22 bp, Homo sapiens
aatggcagaggcaaagatggta

SEQ ID NO: 10055761 - DNA, 22 bp, Homo sapiens
aatgggaggattttctctcttg

SEQ ID NO: 10055762 - DNA, 22 bp, Homo sapiens
aatggcaaaaggataacaagga

SEQ ID NO: 10055763 - DNA, 22 bp, Homo sapiens
agacaatttcaaagtaatatta

SEQ ID NO: 10055764 - DNA, 23 bp, Homo sapiens
aatgggtgcaactatccatgaca

SEQ ID NO: 10055765 - DNA, 22 bp, Homo sapiens
aatgggtttctgtcccagctct

SEQ ID NO: 10055766 - DNA, 22 bp, Homo sapiens
aatgggttgctttccacagcct

SEQ ID NO: 10055767 - DNA, 22 bp, Homo sapiens
aatggtatcacctcacagaatt

SEQ ID NO: 10055768 - DNA, 22 bp, Homo sapiens
aatggtatttgtcaagcatagt

SEQ ID NO: 10055769 - DNA, 22 bp, Homo sapiens
aatggtttggactattcaatag

SEQ ID NO: 10055770 - DNA, 19 bp, Homo sapiens
aatggtttgatgaagtata

SEQ ID NO: 10055771 - DNA, 22 bp, Homo sapiens
aatggtttgatggacaaaatga

SEQ ID NO: 10055772 - DNA, 22 bp, Homo sapiens
aatggttttgcaggtttgtgga

SEQ ID NO: 10055773 - DNA, 22 bp, Homo sapiens
aatggttttctagaacatgaaa

SEQ ID NO: 10055774 - DNA, 22 bp, Homo sapiens
aatggtttgtacctgtccttgg

SEQ ID NO: 10055775 - DNA, 22 bp, Homo sapiens
aatggtttaacatatgcttgag

SEQ ID NO: 10055776 - DNA, 22 bp, Homo sapiens
aatggtttagttaagactgagt

SEQ ID NO: 10055777 - DNA, 22 bp, Homo sapiens
aatggtttatggggaccgcaaa

SEQ ID NO: 10055778 - DNA, 22 bp, Homo sapiens
aatggtttcaaacacactaagt

SEQ ID NO: 10055779 - DNA, 22 bp, Homo sapiens
aatggtttctgaagttaggcag

SEQ ID NO: 10055780 - DNA, 22 bp, Homo sapiens
aatgtcttcagtgtatacatgg

SEQ ID NO: 10055781 - DNA, 22 bp, Homo sapiens
aatggttttgtctcatcaatgt

SEQ ID NO: 10055782 - DNA, 22 bp, Homo sapiens
aatggttttgctttagtattct

SEQ ID NO: 10055783 - DNA, 22 bp, Homo sapiens
aatggtttttagtgagatcgat

SEQ ID NO: 10055784 - DNA, 22 bp, Homo sapiens
aatggtttttgcatattcaggt

SEQ ID NO: 10055785 - DNA, 22 bp, Homo sapiens
aatgtgcagatgaataaacaaa

SEQ ID NO: 10055786 - DNA, 22 bp, Homo sapiens
aatgtgattagcctctactgga

SEQ ID NO: 10055787 - DNA, 18 bp, Homo sapiens
agcagagcccatgcattc

SEQ ID NO: 10055788 - DNA, 22 bp, Homo sapiens
agcagagccaggtctctctgta

SEQ ID NO: 10055789 - DNA, 22 bp, Homo sapiens
acacagaagatctcttaatgct

SEQ ID NO: 10055790 - DNA, 22 bp, Homo sapiens
agcagaaccacagcactgttga

SEQ ID NO: 10055791 - DNA, 22 bp, Homo sapiens
agcagagcaaagctcagaaatg

SEQ ID NO: 10055792 - DNA, 21 bp, Homo sapiens
agcagagccaccattacctgc

SEQ ID NO: 10055793 - DNA, 22 bp, Homo sapiens
acacagatgctatttagtctct

SEQ ID NO: 10055794 - DNA, 22 bp, Homo sapiens
acacagataatgctcatatagg

SEQ ID NO: 10055795 - DNA, 22 bp, Homo sapiens
acacagatattgtacttgatcc

SEQ ID NO: 10055796 - DNA, 22 bp, Homo sapiens
acacagatattttgaatacata

SEQ ID NO: 10055797 - DNA, 22 bp, Homo sapiens
acacagatgcattacacatcta

SEQ ID NO: 10055798 - DNA, 22 bp, Homo sapiens
acacagagtttgacacatggga

SEQ ID NO: 10055799 - DNA, 22 bp, Homo sapiens
acacagagttattatgtgaact

SEQ ID NO: 10055800 - DNA, 22 bp, Homo sapiens
acacagagtggtttgtagaata

SEQ ID NO: 10055801 - DNA, 22 bp, Homo sapiens
acacagagtccttactgaggta

SEQ ID NO: 10055802 - DNA, 20 bp, Homo sapiens
acacagagtgagtctgcttg

SEQ ID NO: 10055803 - DNA, 22 bp, Homo sapiens
acacagagtccttactgaggta

SEQ ID NO: 10055804 - DNA, 22 bp, Homo sapiens
acacagaggcatgacagtggct

SEQ ID NO: 10055805 - DNA, 22 bp, Homo sapiens
acacagaggcatgacagtggct

SEQ ID NO: 10055806 - DNA, 21 bp, Homo sapiens
acacagaggcatcatcacttt

SEQ ID NO: 10055807 - DNA, 22 bp, Homo sapiens
acacagaggaaagtgtgaaggg

SEQ ID NO: 10055808 - DNA, 22 bp, Homo sapiens
acacagaggaaagtgtgaaggg

SEQ ID NO: 10055809 - DNA, 22 bp, Homo sapiens
acacagaggtggccactctttt

SEQ ID NO: 10055810 - DNA, 22 bp, Homo sapiens
acacagagtatcttttgcctag

SEQ ID NO: 10055811 - DNA, 22 bp, Homo sapiens
acacagagggcagaagatacat

SEQ ID NO: 10055812 - DNA, 17 bp, Homo sapiens
acacagggagagggagc

SEQ ID NO: 10055813 - DNA, 17 bp, Homo sapiens
acacagggagagggagc

SEQ ID NO: 10055814 - DNA, 22 bp, Homo sapiens
acacagggaggaggtgctgtgc

SEQ ID NO: 10055815 - DNA, 22 bp, Homo sapiens
acacattaaaacgtctacaatg

SEQ ID NO: 10055816 - DNA, 22 bp, Homo sapiens
acacatgtttacagtcttcagt

SEQ ID NO: 10055817 - DNA, 22 bp, Homo sapiens
acacatgtatatgcttgtgtgt

SEQ ID NO: 10055818 - DNA, 22 bp, Homo sapiens
acactgacgcttgacagtcacc

SEQ ID NO: 10055819 - DNA, 22 bp, Homo sapiens
acactgactgggacagaagacc

SEQ ID NO: 10055820 - DNA, 22 bp, Homo sapiens
acactgagcatctctagaggca

SEQ ID NO: 10055821 - DNA, 22 bp, Homo sapiens
acactgagttttaccaggcaca

SEQ ID NO: 10055822 - DNA, 22 bp, Homo sapiens
acactttactcttacaccattg

SEQ ID NO: 10055823 - DNA, 22 bp, Homo sapiens
acactcaccctcccactgcctg

SEQ ID NO: 10055824 - DNA, 22 bp, Homo sapiens
acactatacttccattgctggt

SEQ ID NO: 10055825 - DNA, 22 bp, Homo sapiens
acacccaggaataaggactggg

SEQ ID NO: 10055826 - DNA, 22 bp, Homo sapiens
acactagctaaatgctgattaa

SEQ ID NO: 10055827 - DNA, 22 bp, Homo sapiens
acacttttaagactttaatgaa

SEQ ID NO: 10055828 - DNA, 22 bp, Homo sapiens
acactttatcaatattcaaaaa

SEQ ID NO: 10055829 - DNA, 22 bp, Homo sapiens
acactttatctcatctcagaca

SEQ ID NO: 10055830 - DNA, 22 bp, Homo sapiens
acagacacaggcgtggagtcgc

SEQ ID NO: 10055831 - DNA, 22 bp, Homo sapiens
acagacagaggctccatgagga

SEQ ID NO: 10055832 - DNA, 22 bp, Homo sapiens
acagactgtgagtctcattttc

SEQ ID NO: 10055833 - DNA, 19 bp, Homo sapiens
agccagggtccagacatgt

SEQ ID NO: 10055834 - DNA, 22 bp, Homo sapiens
agccagggtctctcgctctgtt

SEQ ID NO: 10055835 - DNA, 22 bp, Homo sapiens
acagagaaagtgggctgaagat

SEQ ID NO: 10055836 - DNA, 22 bp, Homo sapiens
acagagacaatatttgtaaagt

SEQ ID NO: 10055837 - DNA, 22 bp, Homo sapiens
acagagacaaatgttagtagtt

SEQ ID NO: 10055838 - DNA, 23 bp, Homo sapiens
acagagacaatggtttcatcttg

SEQ ID NO: 10055839 - DNA, 23 bp, Homo sapiens
acagagacaatggtttcatcttg

SEQ ID NO: 10055840 - DNA, 22 bp, Homo sapiens
acagagacacggaagctaaaga

SEQ ID NO: 10055841 - DNA, 22 bp, Homo sapiens
acagagacctggccttgctttg

SEQ ID NO: 10055842 - DNA, 22 bp, Homo sapiens
acagagaccagttacagcgtcc

SEQ ID NO: 10055843 - DNA, 22 bp, Homo sapiens
acagagactaagcttttcatca

SEQ ID NO: 10055844 - DNA, 22 bp, Homo sapiens
acagagactaagcttttcatca

SEQ ID NO: 10055845 - DNA, 22 bp, Homo sapiens
acagagactcatgaaagatgac

SEQ ID NO: 10055846 - DNA, 22 bp, Homo sapiens
acagagaccagcatcttctgcc

SEQ ID NO: 10055847 - DNA, 22 bp, Homo sapiens
acagagaccagcatcttctgcc

SEQ ID NO: 10055848 - DNA, 22 bp, Homo sapiens
acagagacaggcagacagtctt

SEQ ID NO: 10055849 - DNA, 22 bp, Homo sapiens
acagagagaaacaatcagcagc

SEQ ID NO: 10055850 - DNA, 22 bp, Homo sapiens
acagagagaggcccgaggctgc

SEQ ID NO: 10055851 - DNA, 22 bp, Homo sapiens
acagagagaattgggtttacag

SEQ ID NO: 10055852 - DNA, 20 bp, Homo sapiens
acagagactgagacacttgc

SEQ ID NO: 10055853 - DNA, 20 bp, Homo sapiens
acagagactgagacacttgc

SEQ ID NO: 10055854 - DNA, 22 bp, Homo sapiens
acagagactgggagcaagaggc

SEQ ID NO: 10055855 - DNA, 23 bp, Homo sapiens
acagagactgccaagatattctc

SEQ ID NO: 10055856 - DNA, 23 bp, Homo sapiens
acagagactgccaagatattctc

SEQ ID NO: 10055857 - DNA, 22 bp, Homo sapiens
acagagacttggagcaggctga

SEQ ID NO: 10055858 - DNA, 22 bp, Homo sapiens
acagagactgggatgcctgcct

SEQ ID NO: 10055859 - DNA, 22 bp, Homo sapiens
acagcacagagtggtatggctg

SEQ ID NO: 10055860 - DNA, 19 bp, Homo sapiens
agctcctgattgtgcctcg

SEQ ID NO: 10055861 - DNA, 17 bp, Homo sapiens
agctcctgcccatggct

SEQ ID NO: 10055862 - DNA, 22 bp, Homo sapiens
acagattcactgcactggccat

SEQ ID NO: 10055863 - DNA, 22 bp, Homo sapiens
acagatggagctactaggtaaa

SEQ ID NO: 10055864 - DNA, 22 bp, Homo sapiens
acagagctaaatttcaatccca

SEQ ID NO: 10055865 - DNA, 22 bp, Homo sapiens
acagagctaatgttgcataggc

SEQ ID NO: 10055866 - DNA, 19 bp, Homo sapiens
acagagctctctgcttctg

SEQ ID NO: 10055867 - DNA, 22 bp, Homo sapiens
acagagctaatgttgcataggc

SEQ ID NO: 10055868 - DNA, 22 bp, Homo sapiens
acagagctgggatctgaaccca

SEQ ID NO: 10055869 - DNA, 22 bp, Homo sapiens
acagagccaaaaggacatagta

SEQ ID NO: 10055870 - DNA, 22 bp, Homo sapiens
acagagagctgtgattgagtta

SEQ ID NO: 10055871 - DNA, 22 bp, Homo sapiens
ggcagacacctttatgtctaat

SEQ ID NO: 10055872 - DNA, 19 bp, Homo sapiens
ggcagacacagttgacatg

SEQ ID NO: 10055873 - DNA, 22 bp, Homo sapiens
ggcagacactcaaaagctggga

SEQ ID NO: 10055874 - DNA, 22 bp, Homo sapiens
ggcagacaatctgtctgttagg

SEQ ID NO: 10055875 - DNA, 22 bp, Homo sapiens
ggcagacacaaaaacataaggt

SEQ ID NO: 10055876 - DNA, 23 bp, Homo sapiens
ggagtgtgaagacctgatatagc

SEQ ID NO: 10055877 - DNA, 22 bp, Homo sapiens
ggagtgtgggatggagctcagg

SEQ ID NO: 10055878 - DNA, 22 bp, Homo sapiens
ggcaaggcctgcagctcagtgt

SEQ ID NO: 10055879 - DNA, 22 bp, Homo sapiens
ggagtggcactctgaggcgggg

SEQ ID NO: 10055880 - DNA, 22 bp, Homo sapiens
ggagtggcagcgaggatcagat

SEQ ID NO: 10055881 - DNA, 22 bp, Homo sapiens
ggagtggcagctaggctgtcag

SEQ ID NO: 10055882 - DNA, 22 bp, Homo sapiens
ggagtggccacgactgggagat

SEQ ID NO: 10055883 - DNA, 22 bp, Homo sapiens
ggagtggcctctcctgtgcagg

SEQ ID NO: 10055884 - DNA, 22 bp, Homo sapiens
ggcagaggaagctggaagtggg

SEQ ID NO: 10055885 - DNA, 22 bp, Homo sapiens
ggcaggtgaggcatgtgcctgg

SEQ ID NO: 10055886 - DNA, 22 bp, Homo sapiens
ggcaggcgtggtggcctcagaa

SEQ ID NO: 10055887 - DNA, 22 bp, Homo sapiens
ggaggtgggctaaggactctct

SEQ ID NO: 10055888 - DNA, 22 bp, Homo sapiens
ggaggtggcctgaaaatgtggc

SEQ ID NO: 10055889 - DNA, 22 bp, Homo sapiens
ggagggggaattcagccccagc

SEQ ID NO: 10055890 - DNA, 22 bp, Homo sapiens
ggagggggaaactttggctgcc

SEQ ID NO: 10055891 - DNA, 22 bp, Homo sapiens
ggagggggactgacactgattt

SEQ ID NO: 10055892 - DNA, 22 bp, Homo sapiens
ggaggggtgagaatggctgcct

SEQ ID NO: 10055893 - DNA, 22 bp, Homo sapiens
ggagggtgcattttaccctgtg

SEQ ID NO: 10055894 - DNA, 22 bp, Homo sapiens
ggaggctgagaagtccaagatc

SEQ ID NO: 10055895 - DNA, 22 bp, Homo sapiens
gcttcctgggacaggctatgtg

SEQ ID NO: 10055896 - DNA, 22 bp, Homo sapiens
gcttcatttctctctgtagacc

SEQ ID NO: 10055897 - DNA, 22 bp, Homo sapiens
gcttcagcccatcccagtacat

SEQ ID NO: 10055898 - DNA, 22 bp, Homo sapiens
gcttcagaaatgaacactgtct

SEQ ID NO: 10055899 - DNA, 20 bp, Homo sapiens
gcttcagaacctgggtgctg

SEQ ID NO: 10055900 - DNA, 22 bp, Homo sapiens
gcttcctgtaggcaggtccaag

SEQ ID NO: 10055901 - DNA, 22 bp, Homo sapiens
gcttcggggtccaagcgcgtgt

SEQ ID NO: 10055902 - DNA, 22 bp, Homo sapiens
gcttctaacctgcttcctgtag

SEQ ID NO: 10055903 - DNA, 22 bp, Homo sapiens
gctgggctgcccaacctctgac

SEQ ID NO: 10055904 - DNA, 22 bp, Homo sapiens
gcttaattctggctcagtttcc

SEQ ID NO: 10055905 - DNA, 22 bp, Homo sapiens
gctgggctctttacccctgtac

SEQ ID NO: 10055906 - DNA, 22 bp, Homo sapiens
ggaggaagcacacggcttgtat

SEQ ID NO: 10055907 - DNA, 22 bp, Homo sapiens
ggagctcctggcagtgacagag

SEQ ID NO: 10055908 - DNA, 22 bp, Homo sapiens
ggagaggcttggcccagcctgg

SEQ ID NO: 10055909 - DNA, 22 bp, Homo sapiens
ggagaggcttggcccagcctgg

SEQ ID NO: 10055910 - DNA, 22 bp, Homo sapiens
ggagcctggttactagagcctg

SEQ ID NO: 10055911 - DNA, 22 bp, Homo sapiens
ggagcctgtggccgtcacgact

SEQ ID NO: 10055912 - DNA, 22 bp, Homo sapiens
ggagacacgggtgctgaggacc

SEQ ID NO: 10055913 - DNA, 22 bp, Homo sapiens
ggagacacccacattgctgggt

SEQ ID NO: 10055914 - DNA, 22 bp, Homo sapiens
ggagacacagagcaacaaaata

SEQ ID NO: 10055915 - DNA, 22 bp, Homo sapiens
ggagacacatatacagaaagag

SEQ ID NO: 10055916 - DNA, 22 bp, Homo sapiens
ggagaaggaagaaagctactat

SEQ ID NO: 10055917 - DNA, 22 bp, Homo sapiens
ggagaaggaagaaagctactat

SEQ ID NO: 10055918 - DNA, 22 bp, Homo sapiens
gggtctgagctgaggggaaatc

SEQ ID NO: 10055919 - DNA, 22 bp, Homo sapiens
gggtgggcctgtctggccatgt

SEQ ID NO: 10055920 - DNA, 22 bp, Homo sapiens
gggtgggcccagcccagagaag

SEQ ID NO: 10055921 - DNA, 23 bp, Homo sapiens
gggtgggccaaattaggtagcct

SEQ ID NO: 10055922 - DNA, 22 bp, Homo sapiens
gggggtcccaagctgggctgct

SEQ ID NO: 10055923 - DNA, 22 bp, Homo sapiens
gggggtcccaagctgggctgct

SEQ ID NO: 10055924 - DNA, 22 bp, Homo sapiens
gggggctgtcctgtgcattgta

SEQ ID NO: 10055925 - DNA, 22 bp, Homo sapiens
gggggctggactttcccacaca

SEQ ID NO: 10055926 - DNA, 22 bp, Homo sapiens
gggggctgaggctgttctgagg

SEQ ID NO: 10055927 - DNA, 22 bp, Homo sapiens
gggggctggaatatccatcaac

SEQ ID NO: 10055928 - DNA, 22 bp, Homo sapiens
ggggacgcagaaagagtggcag

SEQ ID NO: 10055929 - DNA, 22 bp, Homo sapiens
ggggactgaggcactgaaggtg

SEQ ID NO: 10055930 - DNA, 23 bp, Homo sapiens
ggggacagagggcagcccgcatc

SEQ ID NO: 10055931 - DNA, 23 bp, Homo sapiens
ggggacagagggcagcccgcatc

SEQ ID NO: 10055932 - DNA, 23 bp, Homo sapiens
ggggacagttcccactggggtct

SEQ ID NO: 10055933 - DNA, 20 bp, Homo sapiens
gggagaagggctgatgagag

SEQ ID NO: 10055934 - DNA, 22 bp, Homo sapiens
gggatggggagctggaaagggg

SEQ ID NO: 10055935 - DNA, 22 bp, Homo sapiens
gggatggctttgtggctgactc

SEQ ID NO: 10055936 - DNA, 22 bp, Homo sapiens
gggatggctcaaaggagtcagg

SEQ ID NO: 10055937 - DNA, 22 bp, Homo sapiens
gggcagcacgtttcaggaggat

SEQ ID NO: 10055938 - DNA, 20 bp, Homo sapiens
gggcagcctcgggagtgggt

SEQ ID NO: 10055939 - DNA, 22 bp, Homo sapiens
gggccatgagaggttcatcaac

SEQ ID NO: 10055940 - DNA, 22 bp, Homo sapiens
gggccatgagaggttcatcaac

SEQ ID NO: 10055941 - DNA, 22 bp, Homo sapiens
gggctaaatgcagaaatgcaga

SEQ ID NO: 10055942 - DNA, 22 bp, Homo sapiens
gggctactgagctggaactggg

SEQ ID NO: 10055943 - DNA, 22 bp, Homo sapiens
gggcctgttctgattggcagat

SEQ ID NO: 10055944 - DNA, 22 bp, Homo sapiens
ggccatggtgaggtcttctcag

SEQ ID NO: 10055945 - DNA, 22 bp, Homo sapiens
ggccatggtggtttgagcacct

SEQ ID NO: 10055946 - DNA, 20 bp, Homo sapiens
ggccatgggttgcctgaggt

SEQ ID NO: 10055947 - DNA, 22 bp, Homo sapiens
ggccatggtcatgggtgagctt

SEQ ID NO: 10055948 - DNA, 22 bp, Homo sapiens
ggccatggtcatgggtgagctt

SEQ ID NO: 10055949 - DNA, 22 bp, Homo sapiens
ggcccagccggcgagtctcgcg

SEQ ID NO: 10055950 - DNA, 22 bp, Homo sapiens
ggcccagcccgagtcagccttc

SEQ ID NO: 10055951 - DNA, 22 bp, Homo sapiens
ggccccagattctgggctgggt

SEQ ID NO: 10055952 - DNA, 22 bp, Homo sapiens
ggccccagattctgggctgggt

SEQ ID NO: 10055953 - DNA, 22 bp, Homo sapiens
ggccccagcagaccctcctctg

SEQ ID NO: 10055954 - DNA, 22 bp, Homo sapiens
ggcccagcctcagacatgccct

SEQ ID NO: 10055955 - DNA, 22 bp, Homo sapiens
ggccccagttcactcctggccg

SEQ ID NO: 10055956 - DNA, 22 bp, Homo sapiens
ggccccagttcactcctggccg

SEQ ID NO: 10055957 - DNA, 22 bp, Homo sapiens
ggccccaggtctgaacacgctg

SEQ ID NO: 10055958 - DNA, 22 bp, Homo sapiens
ggcaggtgctctgtgggcctgg

SEQ ID NO: 10055959 - DNA, 22 bp, Homo sapiens
ggccatgggaagaggtggagag

SEQ ID NO: 10055960 - DNA, 22 bp, Homo sapiens
ggccctgcgattaggtggcagg

SEQ ID NO: 10055961 - DNA, 22 bp, Homo sapiens
ggctccacaattacacactgga

SEQ ID NO: 10055962 - DNA, 22 bp, Homo sapiens
ggctcctggaggcaccactggt

SEQ ID NO: 10055963 - DNA, 22 bp, Homo sapiens
ggctcctggaggcaccactggt

SEQ ID NO: 10055964 - DNA, 23 bp, Homo sapiens
ggctcctggattcaaatcctgcc

SEQ ID NO: 10055965 - DNA, 22 bp, Homo sapiens
ggctgcaggcagaggctgtctg

SEQ ID NO: 10055966 - DNA, 22 bp, Homo sapiens
ggctgcaggatgcccagccgtg

SEQ ID NO: 10055967 - DNA, 23 bp, Homo sapiens
ggctgctcttttcatgctgtttc

SEQ ID NO: 10055968 - DNA, 22 bp, Homo sapiens
ggctgctcggagcctcctgtga

SEQ ID NO: 10055969 - DNA, 22 bp, Homo sapiens
ggctggctacattggaggaagg

SEQ ID NO: 10055970 - DNA, 22 bp, Homo sapiens
ggctggctatctgtggttgcct

SEQ ID NO: 10055971 - DNA, 22 bp, Homo sapiens
ggcttcccagtccctgctctca

SEQ ID NO: 10055972 - DNA, 22 bp, Homo sapiens
ggctggctcagggcttgagaga

SEQ ID NO: 10055973 - DNA, 22 bp, Homo sapiens
ggctggctccacctaggtagct

SEQ ID NO: 10055974 - DNA, 22 bp, Homo sapiens
ggctggctcatgcaaagggtga

SEQ ID NO: 10055975 - DNA, 22 bp, Homo sapiens
ggctggctgataaagggttgag

SEQ ID NO: 10055976 - DNA, 22 bp, Homo sapiens
ggctggctcttaccgacagcgt

SEQ ID NO: 10055977 - DNA, 22 bp, Homo sapiens
ggctggctcttaccgacagcgt

SEQ ID NO: 10055978 - DNA, 22 bp, Homo sapiens
ggctggctggatgaatggatta

SEQ ID NO: 10055979 - DNA, 22 bp, Homo sapiens
ggctggctgcatgccccctcct

SEQ ID NO: 10055980 - DNA, 22 bp, Homo sapiens
ggctggctggcttagcagagga

SEQ ID NO: 10055981 - DNA, 22 bp, Homo sapiens
ggctggctggctggtagacaag

SEQ ID NO: 10055982 - DNA, 22 bp, Homo sapiens
ggctggctgtgccctgtactct

SEQ ID NO: 10055983 - DNA, 22 bp, Homo sapiens
ggctggcttgccaagctcaggg

SEQ ID NO: 10055984 - DNA, 22 bp, Homo sapiens
ggctttggggtgtgcagagatg

SEQ ID NO: 10055985 - DNA, 22 bp, Homo sapiens
ggctttgggggtgtccaagaaa

SEQ ID NO: 10055986 - DNA, 22 bp, Homo sapiens
gggaagagatttccacatcatt

SEQ ID NO: 10055987 - DNA, 22 bp, Homo sapiens
gttcaagaccagcctggccaac

SEQ ID NO: 10055988 - DNA, 22 bp, Homo sapiens
gttctgacttctctgcatctgc

SEQ ID NO: 10055989 - DNA, 22 bp, Homo sapiens
gttctcagtggggagcagggtt

SEQ ID NO: 10055990 - DNA, 22 bp, Homo sapiens
gttctgctcctgtggcaatcta

SEQ ID NO: 10055991 - DNA, 22 bp, Homo sapiens
gttctgcagggatccagctggg

SEQ ID NO: 10055992 - DNA, 22 bp, Homo sapiens
gttgtatttgcctgaatgcagt

SEQ ID NO: 10055993 - DNA, 22 bp, Homo sapiens
gttgtatttgcctgaatgcagt

SEQ ID NO: 10055994 - DNA, 22 bp, Homo sapiens
gttgtattcttcaatatcagag

SEQ ID NO: 10055995 - DNA, 22 bp, Homo sapiens
gtgtgcagaacagggagtgggt

SEQ ID NO: 10055996 - DNA, 22 bp, Homo sapiens
gtgtgcagcagagacaggactc

SEQ ID NO: 10055997 - DNA, 22 bp, Homo sapiens
gtgtggtggccctccttcaggc

SEQ ID NO: 10055998 - DNA, 22 bp, Homo sapiens
gtgtggtgaggccccttaggct

SEQ ID NO: 10055999 - DNA, 22 bp, Homo sapiens
gtgtggtcgaagttctcccgga

SEQ ID NO: 10056000 - DNA, 22 bp, Homo sapiens
gtgtgggaggaaggtgaacaga

SEQ ID NO: 10056001 - DNA, 22 bp, Homo sapiens
gtgtgggacgggtgagtggcca

SEQ ID NO: 10056002 - DNA, 22 bp, Homo sapiens
gtgtcactggaatactgtctgt

SEQ ID NO: 10056003 - DNA, 22 bp, Homo sapiens
gtgtcctgggggacttcaggtt

SEQ ID NO: 10056004 - DNA, 22 bp, Homo sapiens
gtgtcctgccaccctgggcttt

SEQ ID NO: 10056005 - DNA, 18 bp, Homo sapiens
gtgtcctggctgcggcgc

SEQ ID NO: 10056006 - DNA, 22 bp, Homo sapiens
gtgtcctgcattggctctgccc

SEQ ID NO: 10056007 - DNA, 22 bp, Homo sapiens
gtgtcctgagtgaggcctggcc

SEQ ID NO: 10056008 - DNA, 19 bp, Homo sapiens
gtgtacagctcagtgaatt

SEQ ID NO: 10056009 - DNA, 22 bp, Homo sapiens
gtgtacagatatctcacgttct

SEQ ID NO: 10056010 - DNA, 22 bp, Homo sapiens
gtgtacaggatgactgtactta

SEQ ID NO: 10056011 - DNA, 22 bp, Homo sapiens
gtgtcaacagccgaagataaat

SEQ ID NO: 10056012 - DNA, 22 bp, Homo sapiens
gtggtttgttttattcctggaa

SEQ ID NO: 10056013 - DNA, 22 bp, Homo sapiens
gtgtaaagatgccaggaatctt

SEQ ID NO: 10056014 - DNA, 22 bp, Homo sapiens
gtgtaaaaacatactatttcta

SEQ ID NO: 10056015 - DNA, 22 bp, Homo sapiens
gtggtttgtgcatagctcctat

SEQ ID NO: 10056016 - DNA, 22 bp, Homo sapiens
gtggtgtttgagctgccaggga

SEQ ID NO: 10056017 - DNA, 22 bp, Homo sapiens
gtggtgttcccacgcctgctag

SEQ ID NO: 10056018 - DNA, 22 bp, Homo sapiens
gtggtgtttgccagttaataac

SEQ ID NO: 10056019 - DNA, 22 bp, Homo sapiens
gtggtgtttttggggcagagga

SEQ ID NO: 10056020 - DNA, 22 bp, Homo sapiens
gtggggtgcagcagtactgtgt

SEQ ID NO: 10056021 - DNA, 22 bp, Homo sapiens
gtggggtagatctttctcagga

SEQ ID NO: 10056022 - DNA, 22 bp, Homo sapiens
gtgggtgatgtactggaggcca

SEQ ID NO: 10056023 - DNA, 22 bp, Homo sapiens
gtgggtggagactgggtgcaag

SEQ ID NO: 10056024 - DNA, 22 bp, Homo sapiens
gtgggtggagactgggtgcaag

SEQ ID NO: 10056025 - DNA, 20 bp, Homo sapiens
gtggtattcagtaacagtga

SEQ ID NO: 10056026 - DNA, 22 bp, Homo sapiens
gtgggcagcctgtccggagacc

SEQ ID NO: 10056027 - DNA, 22 bp, Homo sapiens
gtgggcagtggtttgcgcggtc

SEQ ID NO: 10056028 - DNA, 22 bp, Homo sapiens
gtggggaggcattcttctccct

SEQ ID NO: 10056029 - DNA, 22 bp, Homo sapiens
gtggggaggcctaagcaagttg

SEQ ID NO: 10056030 - DNA, 22 bp, Homo sapiens
gtgggccaggcgtctaggccct

SEQ ID NO: 10056031 - DNA, 22 bp, Homo sapiens
taacagaatttgctaaactccg

SEQ ID NO: 10056032 - DNA, 22 bp, Homo sapiens
taacagaatagcagaaacagaa

SEQ ID NO: 10056033 - DNA, 22 bp, Homo sapiens
taaatctttaggaagctcaaac

SEQ ID NO: 10056034 - DNA, 22 bp, Homo sapiens
taaatcttgtggcaatgcttct

SEQ ID NO: 10056035 - DNA, 22 bp, Homo sapiens
taaatccttatcttctttgaat

SEQ ID NO: 10056036 - DNA, 18 bp, Homo sapiens
taaatctctctttagtca

SEQ ID NO: 10056037 - DNA, 21 bp, Homo sapiens
taaatctctgtattcttcagt

SEQ ID NO: 10056038 - DNA, 22 bp, Homo sapiens
taaatgagggctgacatgattg

SEQ ID NO: 10056039 - DNA, 22 bp, Homo sapiens
taaatgaagaaatggagattgt

SEQ ID NO: 10056040 - DNA, 22 bp, Homo sapiens
taaatgacaacacctgcttttg

SEQ ID NO: 10056041 - DNA, 22 bp, Homo sapiens
taaatgacattcttaagtcttg

SEQ ID NO: 10056042 - DNA, 22 bp, Homo sapiens
taaaggctcactggcttggggt

SEQ ID NO: 10056043 - DNA, 22 bp, Homo sapiens
taaaggcttttacaggagtgca

SEQ ID NO: 10056044 - DNA, 22 bp, Homo sapiens
taaaggcttctgcagggactga

SEQ ID NO: 10056045 - DNA, 22 bp, Homo sapiens
taaaggctcgtattgttgtgtg

SEQ ID NO: 10056046 - DNA, 19 bp, Homo sapiens
taaaacgtgcatggcagca

SEQ ID NO: 10056047 - DNA, 22 bp, Homo sapiens
gtttaagtttcagaagctaaga

SEQ ID NO: 10056048 - DNA, 22 bp, Homo sapiens
gtttaataatgttgaattacta

SEQ ID NO: 10056049 - DNA, 22 bp, Homo sapiens
gtttaaataattaggggcctgt

SEQ ID NO: 10056050 - DNA, 22 bp, Homo sapiens
gttttttcatgagtagttatct

SEQ ID NO: 10056051 - DNA, 22 bp, Homo sapiens
gtttttctttgtgtgaagacaa

SEQ ID NO: 10056052 - DNA, 22 bp, Homo sapiens
gtttttctagactgggagtttg

SEQ ID NO: 10056053 - DNA, 22 bp, Homo sapiens
gtttttctgtgagcggtaaagg

SEQ ID NO: 10056054 - DNA, 22 bp, Homo sapiens
gtttttctctgaaatagttgac

SEQ ID NO: 10056055 - DNA, 20 bp, Homo sapiens
gtttttctctcttgccacta

SEQ ID NO: 10056056 - DNA, 22 bp, Homo sapiens
gtggctgcagcggctgtggaga

SEQ ID NO: 10056057 - DNA, 22 bp, Homo sapiens
gtggctgcatcggggtgaccag

SEQ ID NO: 10056058 - DNA, 22 bp, Homo sapiens
gtggctgctgtcctctctggtt

SEQ ID NO: 10056059 - DNA, 22 bp, Homo sapiens
gtggctgggctccgagcggctt

SEQ ID NO: 10056060 - DNA, 22 bp, Homo sapiens
gtggctgggctccgagcggctt

SEQ ID NO: 10056061 - DNA, 22 bp, Homo sapiens
gtggctggtttcctgcatgcaa

SEQ ID NO: 10056062 - DNA, 22 bp, Homo sapiens
gtggctggtttcctgcatgcaa

SEQ ID NO: 10056063 - DNA, 22 bp, Homo sapiens
gtgggagctttggcatcaggct

SEQ ID NO: 10056064 - DNA, 22 bp, Homo sapiens
gtggctcttgcatggggtctct

SEQ ID NO: 10056065 - DNA, 22 bp, Homo sapiens
gtggctctccattgacatggaa

SEQ ID NO: 10056066 - DNA, 22 bp, Homo sapiens
gtggctctccattgacatggaa

SEQ ID NO: 10056067 - DNA, 22 bp, Homo sapiens
gtggctcttgcatggggtctct

SEQ ID NO: 10056068 - DNA, 22 bp, Homo sapiens
gtggcctggctggcaccacctc

SEQ ID NO: 10056069 - DNA, 22 bp, Homo sapiens
gtggctctaggtgagcatggag

SEQ ID NO: 10056070 - DNA, 22 bp, Homo sapiens
gtggcctggatagactccatct

SEQ ID NO: 10056071 - DNA, 22 bp, Homo sapiens
gtggcattgacatgtaaacagt

SEQ ID NO: 10056072 - DNA, 22 bp, Homo sapiens
gtggcatggagaaggaggcagt

SEQ ID NO: 10056073 - DNA, 22 bp, Homo sapiens
gtggcagttgctgtggcaataa

SEQ ID NO: 10056074 - DNA, 20 bp, Homo sapiens
gtggcagtggtggcagcagt

SEQ ID NO: 10056075 - DNA, 22 bp, Homo sapiens
gtggcaggagagacacagccat

SEQ ID NO: 10056076 - DNA, 20 bp, Homo sapiens
gtggcaggcagtgaaggagc

SEQ ID NO: 10056077 - DNA, 22 bp, Homo sapiens
gtggccagaatcttgaggcctt

SEQ ID NO: 10056078 - DNA, 22 bp, Homo sapiens
gtggccagccagggtgctgatg

SEQ ID NO: 10056079 - DNA, 22 bp, Homo sapiens
gtggccagccccatggacagtt

SEQ ID NO: 10056080 - DNA, 18 bp, Homo sapiens
gtggccagcctggtcttg

SEQ ID NO: 10056081 - DNA, 22 bp, Homo sapiens
gtggccaggacattgccaggca

SEQ ID NO: 10056082 - DNA, 22 bp, Homo sapiens
gtggccaggagaccttgggcat

SEQ ID NO: 10056083 - DNA, 22 bp, Homo sapiens
gtggccaggagagggtgggaca

SEQ ID NO: 10056084 - DNA, 22 bp, Homo sapiens
gtgcctgccccactcctcagca

SEQ ID NO: 10056085 - DNA, 22 bp, Homo sapiens
gtgcctggaactgggtaggctg

SEQ ID NO: 10056086 - DNA, 22 bp, Homo sapiens
gtggaagaggcaagatagctct

SEQ ID NO: 10056087 - DNA, 22 bp, Homo sapiens
gtgcctggcagggtcagctgct

SEQ ID NO: 10056088 - DNA, 22 bp, Homo sapiens
gtgcctggcatgcgccggtgct

SEQ ID NO: 10056089 - DNA, 22 bp, Homo sapiens
gtggcagcagaggggtggtatg

SEQ ID NO: 10056090 - DNA, 22 bp, Homo sapiens
gtggcagcagaggggtggtatg

SEQ ID NO: 10056091 - DNA, 22 bp, Homo sapiens
gtggatgcttaggcagcctggg

SEQ ID NO: 10056092 - DNA, 22 bp, Homo sapiens
gtaaatataaatgctagctgcc

SEQ ID NO: 10056093 - DNA, 22 bp, Homo sapiens
gtacaggaaggagggagtttca

SEQ ID NO: 10056094 - DNA, 22 bp, Homo sapiens
gtacaggaccgcggccccctgg

SEQ ID NO: 10056095 - DNA, 22 bp, Homo sapiens
ggtgtcctcggattcagggcag

SEQ ID NO: 10056096 - DNA, 21 bp, Homo sapiens
ggtgtcctgagggataggtag

SEQ ID NO: 10056097 - DNA, 22 bp, Homo sapiens
gtacatttactgatgaaaagta

SEQ ID NO: 10056098 - DNA, 22 bp, Homo sapiens
gtacatttaggattcattgaaa

SEQ ID NO: 10056099 - DNA, 22 bp, Homo sapiens
gtacataagaaattactacaga

SEQ ID NO: 10056100 - DNA, 19 bp, Homo sapiens
gtacagtggtaagctatga

SEQ ID NO: 10056101 - DNA, 22 bp, Homo sapiens
gtatataaggtaaagcgattgt

SEQ ID NO: 10056102 - DNA, 22 bp, Homo sapiens
gtatactcaacctgcctagaat

SEQ ID NO: 10056103 - DNA, 22 bp, Homo sapiens
gtatactcatgtctcagaggac

SEQ ID NO: 10056104 - DNA, 20 bp, Homo sapiens
gtatataaccatagtgacta

SEQ ID NO: 10056105 - DNA, 22 bp, Homo sapiens
gggtggggccaggcaatttgca

SEQ ID NO: 10056106 - DNA, 22 bp, Homo sapiens
gggtggggcccaggaaatctat

SEQ ID NO: 10056107 - DNA, 22 bp, Homo sapiens
gggtggggttcaggaatcttca

SEQ ID NO: 10056108 - DNA, 22 bp, Homo sapiens
gggtggggtgtatcggatccta

SEQ ID NO: 10056109 - DNA, 22 bp, Homo sapiens
ggtgaggggagagtgaaagaaa

SEQ ID NO: 10056110 - DNA, 22 bp, Homo sapiens
ggtgagggtaaatataggcaaa

SEQ ID NO: 10056111 - DNA, 22 bp, Homo sapiens
ggtgattctgtgaggggctgac

SEQ ID NO: 10056112 - DNA, 22 bp, Homo sapiens
ggtgcaggacgaagtgggggtt

SEQ ID NO: 10056113 - DNA, 22 bp, Homo sapiens
ggtggccaggccagctctggcc

SEQ ID NO: 10056114 - DNA, 22 bp, Homo sapiens
ggtggcagttacaggggcaaat

SEQ ID NO: 10056115 - DNA, 22 bp, Homo sapiens
ggtggcatctcagttcatgggc

SEQ ID NO: 10056116 - DNA, 22 bp, Homo sapiens
ggtggcattcagaagagctggc

SEQ ID NO: 10056117 - DNA, 22 bp, Homo sapiens
ggtgtagctctgtgtcccactg

SEQ ID NO: 10056118 - DNA, 22 bp, Homo sapiens
ggtgtcagatacataggaagta

SEQ ID NO: 10056119 - DNA, 22 bp, Homo sapiens
ggtgtccgcgctgtagaaggtc

SEQ ID NO: 10056120 - DNA, 22 bp, Homo sapiens
gtctgagaggaggcagcctcgg

SEQ ID NO: 10056121 - DNA, 22 bp, Homo sapiens
gtctgagaggagccaagtattg

SEQ ID NO: 10056122 - DNA, 20 bp, Homo sapiens
gtctgaggagcagtgggaaa

SEQ ID NO: 10056123 - DNA, 22 bp, Homo sapiens
gtctgaaaatgccctacgattg

SEQ ID NO: 10056124 - DNA, 22 bp, Homo sapiens
gtctcttttatggtgagttgat

SEQ ID NO: 10056125 - DNA, 22 bp, Homo sapiens
gtctgagaaagaattctgggga

SEQ ID NO: 10056126 - DNA, 22 bp, Homo sapiens
gtctgagaactactgaggataa

SEQ ID NO: 10056127 - DNA, 22 bp, Homo sapiens
gtctgagactgggcacatacct

SEQ ID NO: 10056128 - DNA, 22 bp, Homo sapiens
gtctgagacccactcccagaga

SEQ ID NO: 10056129 - DNA, 22 bp, Homo sapiens
gtctgagaatcttgcatatcat

SEQ ID NO: 10056130 - DNA, 22 bp, Homo sapiens
gtccttcatttcctgatctcta

SEQ ID NO: 10056131 - DNA, 21 bp, Homo sapiens
gtccttcattatcaagtcaaa

SEQ ID NO: 10056132 - DNA, 22 bp, Homo sapiens
gtccttcagctttatctgaaca

SEQ ID NO: 10056133 - DNA, 22 bp, Homo sapiens
gtccttcatatcatggattata

SEQ ID NO: 10056134 - DNA, 22 bp, Homo sapiens
gtccttcagggagtcaaacact

SEQ ID NO: 10056135 - DNA, 22 bp, Homo sapiens
gtccttcatctggagcctggtc

SEQ ID NO: 10056136 - DNA, 22 bp, Homo sapiens
gtccttcatggagttacagcct

SEQ ID NO: 10056137 - DNA, 22 bp, Homo sapiens
gtccttcaagtaacctgggacc

SEQ ID NO: 10056138 - DNA, 22 bp, Homo sapiens
gtccttcaaggtccttggtgtg

SEQ ID NO: 10056139 - DNA, 22 bp, Homo sapiens
gtccttcagcacctccctcggc

SEQ ID NO: 10056140 - DNA, 21 bp, Homo sapiens
gtccttcagcaagttagtggc

SEQ ID NO: 10056141 - DNA, 22 bp, Homo sapiens
gtccttcaagagtcccctactg

SEQ ID NO: 10056142 - DNA, 22 bp, Homo sapiens
gtccttatttcacttaaacgta

SEQ ID NO: 10056143 - DNA, 22 bp, Homo sapiens
gtccttcaaaggcacgcagtta

SEQ ID NO: 10056144 - DNA, 22 bp, Homo sapiens
gctgagcacacctagggtagag

SEQ ID NO: 10056145 - DNA, 22 bp, Homo sapiens
gctgagcacagcctgtgtcctc

SEQ ID NO: 10056146 - DNA, 22 bp, Homo sapiens
gctctgcccaatgtccctacac

SEQ ID NO: 10056147 - DNA, 22 bp, Homo sapiens
gctcttctaaagaatgtacagg

SEQ ID NO: 10056148 - DNA, 22 bp, Homo sapiens
gctcctctgtcaaatgagagtg

SEQ ID NO: 10056149 - DNA, 22 bp, Homo sapiens
gctcctctcctcggagtcgggg

SEQ ID NO: 10056150 - DNA, 22 bp, Homo sapiens
gctccagatgaatgcacttgtt

SEQ ID NO: 10056151 - DNA, 22 bp, Homo sapiens
gctccagatgaaaggccagagg

SEQ ID NO: 10056152 - DNA, 22 bp, Homo sapiens
gctccagagtgtggcatctggg

SEQ ID NO: 10056153 - DNA, 22 bp, Homo sapiens
gctcatgtgtgattacagtttt

SEQ ID NO: 10056154 - DNA, 22 bp, Homo sapiens
gctcatttcttctttccacaat

SEQ ID NO: 10056155 - DNA, 22 bp, Homo sapiens
gctccagagcagagactaggtt

SEQ ID NO: 10056156 - DNA, 22 bp, Homo sapiens
gccttactgagggcaattttga

SEQ ID NO: 10056157 - DNA, 22 bp, Homo sapiens
gctcactggcctgaagaggacg

SEQ ID NO: 10056158 - DNA, 22 bp, Homo sapiens
gctggcctgacctgaggctggg

SEQ ID NO: 10056159 - DNA, 22 bp, Homo sapiens
gctggcctgcaaagcccggctg

SEQ ID NO: 10056160 - DNA, 22 bp, Homo sapiens
gctggcctctacaggccggcca

SEQ ID NO: 10056161 - DNA, 22 bp, Homo sapiens
gctggcctgaccagccacaggc

SEQ ID NO: 10056162 - DNA, 22 bp, Homo sapiens
gctggagaggggtcactctgag

SEQ ID NO: 10056163 - DNA, 22 bp, Homo sapiens
gctggagatagtaggatccata

SEQ ID NO: 10056164 - DNA, 22 bp, Homo sapiens
gctggagatagaatggccactg

SEQ ID NO: 10056165 - DNA, 22 bp, Homo sapiens
gctgggagtgggcaagatgaga

SEQ ID NO: 10056166 - DNA, 22 bp, Homo sapiens
gctggcctgggcagcctgtcgg

SEQ ID NO: 10056167 - DNA, 22 bp, Homo sapiens
gctggcctgctgggcaccaccg

SEQ ID NO: 10056168 - DNA, 22 bp, Homo sapiens
gctggcctgggctcaagaccag

SEQ ID NO: 10056169 - DNA, 22 bp, Homo sapiens
gctgggcagcctggccgctgcc

SEQ ID NO: 10056170 - DNA, 21 bp, Homo sapiens
gctgctcgagatccagtgctt

SEQ ID NO: 10056171 - DNA, 22 bp, Homo sapiens
gctgcctggtttctcagctgca

SEQ ID NO: 10056172 - DNA, 16 bp, Homo sapiens
gctgctgcttcctgct

SEQ ID NO: 10056173 - DNA, 22 bp, Homo sapiens
gctgctgctggtctggggccac

SEQ ID NO: 10056174 - DNA, 22 bp, Homo sapiens
gctgctgctgaggatgcacctg

SEQ ID NO: 10056175 - DNA, 22 bp, Homo sapiens
gctgctgcgcttgtctactgtt

SEQ ID NO: 10056176 - DNA, 19 bp, Homo sapiens
gctgctgctcctccctcgc

SEQ ID NO: 10056177 - DNA, 22 bp, Homo sapiens
gctgctgcctgtagccagggtg

SEQ ID NO: 10056178 - DNA, 22 bp, Homo sapiens
gctgctgccgcggccgctggga

SEQ ID NO: 10056179 - DNA, 21 bp, Homo sapiens
gctgctgcccctagtgaggcc

SEQ ID NO: 10056180 - DNA, 22 bp, Homo sapiens
gctgctgcaagagccagctctt

SEQ ID NO: 10056181 - DNA, 22 bp, Homo sapiens
gctgctgcatgaacagcggtca

SEQ ID NO: 10056182 - DNA, 22 bp, Homo sapiens
gctgagctagctatctcagtct

SEQ ID NO: 10056183 - DNA, 22 bp, Homo sapiens
gctgagctcccagcagtatctg

SEQ ID NO: 10056184 - DNA, 22 bp, Homo sapiens
gctgcctggagaggcagggatg

SEQ ID NO: 10056185 - DNA, 23 bp, Homo sapiens
gcctgctgtcacagcgggcccag

SEQ ID NO: 10056186 - DNA, 22 bp, Homo sapiens
gcctgctgggagacacccccag

SEQ ID NO: 10056187 - DNA, 22 bp, Homo sapiens
gcctgctcagacctagcaggcc

SEQ ID NO: 10056188 - DNA, 22 bp, Homo sapiens
gcctgccttttggaggcacatt

SEQ ID NO: 10056189 - DNA, 21 bp, Homo sapiens
gcctgctgttcaccctgccac

SEQ ID NO: 10056190 - DNA, 22 bp, Homo sapiens
gcctggagcctcagcaaggagg

SEQ ID NO: 10056191 - DNA, 22 bp, Homo sapiens
gcctggagggctctagagaggc

SEQ ID NO: 10056192 - DNA, 22 bp, Homo sapiens
gcctgttggtgactttctgttg

SEQ ID NO: 10056193 - DNA, 22 bp, Homo sapiens
gcctgttctccagcatccaggt

SEQ ID NO: 10056194 - DNA, 22 bp, Homo sapiens
gcctgttgggtaacagagttca

SEQ ID NO: 10056195 - DNA, 22 bp, Homo sapiens
gcctgtgtggatgcgccggtgc

SEQ ID NO: 10056196 - DNA, 21 bp, Homo sapiens
gcctgggatagtggcctccgg

SEQ ID NO: 10056197 - DNA, 22 bp, Homo sapiens
gcctggagtactccttgaagtg

SEQ ID NO: 10056198 - DNA, 22 bp, Homo sapiens
gcctggagggttgaggttttgt

SEQ ID NO: 10056199 - DNA, 21 bp, Homo sapiens
gcctgggaaatctgggaagcc

SEQ ID NO: 10056200 - DNA, 22 bp, Homo sapiens
gcctctgctcggactttgcctc

SEQ ID NO: 10056201 - DNA, 22 bp, Homo sapiens
gcctcctgttatgccatgtgcc

SEQ ID NO: 10056202 - DNA, 22 bp, Homo sapiens
gccgtgtcatctgcgggtggca

SEQ ID NO: 10056203 - DNA, 22 bp, Homo sapiens
gccgggtgcagcgggcccgcca

SEQ ID NO: 10056204 - DNA, 22 bp, Homo sapiens
gccgtggcttctccagctggct

SEQ ID NO: 10056205 - DNA, 22 bp, Homo sapiens
gccgggaccaaggccacggagc

SEQ ID NO: 10056206 - DNA, 22 bp, Homo sapiens
gccagtggtcagtgggagggtg

SEQ ID NO: 10056207 - DNA, 22 bp, Homo sapiens
gcagggtgaaggtcacatagaa

SEQ ID NO: 10056208 - DNA, 22 bp, Homo sapiens
gcagggaccttgcccaccctcc

SEQ ID NO: 10056209 - DNA, 22 bp, Homo sapiens
gcagggacgcagcactctccgt

SEQ ID NO: 10056210 - DNA, 22 bp, Homo sapiens
gcaggctgtggtatgttgggca

SEQ ID NO: 10056211 - DNA, 22 bp, Homo sapiens
gcaggctggaggctgttctggg

SEQ ID NO: 10056212 - DNA, 22 bp, Homo sapiens
gcaggctgccaccttctgagtt

SEQ ID NO: 10056213 - DNA, 22 bp, Homo sapiens
gcagagcctgtgtctgagcaaa

SEQ ID NO: 10056214 - DNA, 22 bp, Homo sapiens
gcagagctcaaggtgttcagct

SEQ ID NO: 10056215 - DNA, 22 bp, Homo sapiens
gcagagcggtgatcaggcgcag

SEQ ID NO: 10056216 - DNA, 22 bp, Homo sapiens
gcagagctatcttctggatttg

SEQ ID NO: 10056217 - DNA, 22 bp, Homo sapiens
gcagcgctactcacagctctga

SEQ ID NO: 10056218 - DNA, 22 bp, Homo sapiens
gcagctcctggcacagtttttt

SEQ ID NO: 10056219 - DNA, 22 bp, Homo sapiens
gcaggagaacaaagcaagctgc

SEQ ID NO: 10056220 - DNA, 22 bp, Homo sapiens
gcaggagaaatgaagattgggt

SEQ ID NO: 10056221 - DNA, 22 bp, Homo sapiens
gcagtgggagcttaggcagtgc

SEQ ID NO: 10056222 - DNA, 22 bp, Homo sapiens
gcagtgggcaacaagagctgga

SEQ ID NO: 10056223 - DNA, 22 bp, Homo sapiens
gcagtgtctttgacctccaccc

SEQ ID NO: 10056224 - DNA, 19 bp, Homo sapiens
gcaggtggatgtggtcagc

SEQ ID NO: 10056225 - DNA, 22 bp, Homo sapiens
gcagggtgccgacttcagggat

SEQ ID NO: 10056226 - DNA, 22 bp, Homo sapiens
gcagggtggatggcagggccag

SEQ ID NO: 10056227 - DNA, 22 bp, Homo sapiens
gcagggtgatagtgaggctcag

SEQ ID NO: 10056228 - DNA, 22 bp, Homo sapiens
gcagggtgatagtgaggctcag

SEQ ID NO: 10056229 - DNA, 22 bp, Homo sapiens
gcagggtgacgttgcccacctc

SEQ ID NO: 10056230 - DNA, 22 bp, Homo sapiens
gcaggtggtggggctatgatct

SEQ ID NO: 10056231 - DNA, 22 bp, Homo sapiens
gcaggtggttaaggtcccatgt

SEQ ID NO: 10056232 - DNA, 22 bp, Homo sapiens
gcaggtgggggtcggtgcatct

SEQ ID NO: 10056233 - DNA, 22 bp, Homo sapiens
gcaggtggggctgctaccagaa

SEQ ID NO: 10056234 - DNA, 22 bp, Homo sapiens
gccacagctccagtcaggtgac

SEQ ID NO: 10056235 - DNA, 22 bp, Homo sapiens
gccacagcttagatcacagcct

SEQ ID NO: 10056236 - DNA, 22 bp, Homo sapiens
gccacagcttttaacctcgggg

SEQ ID NO: 10056237 - DNA, 22 bp, Homo sapiens
gccagcaagggtccactgtcac

SEQ ID NO: 10056238 - DNA, 22 bp, Homo sapiens
gccagcaccagctactagtcac

SEQ ID NO: 10056239 - DNA, 22 bp, Homo sapiens
gccagcaccttctcatatgttt

SEQ ID NO: 10056240 - DNA, 22 bp, Homo sapiens
gccagcagctgtggggtggcca

SEQ ID NO: 10056241 - DNA, 22 bp, Homo sapiens
gccagcagggaagccttgggct

SEQ ID NO: 10056242 - DNA, 22 bp, Homo sapiens
gccacagcccgagcaccatgag

SEQ ID NO: 10056243 - DNA, 22 bp, Homo sapiens
gccacagcagggccctctcagg

SEQ ID NO: 10056244 - DNA, 22 bp, Homo sapiens
gccacagcctctgggaaaactc

SEQ ID NO: 10056245 - DNA, 22 bp, Homo sapiens
gccaatgccttctagaggagtc

SEQ ID NO: 10056246 - DNA, 22 bp, Homo sapiens
gcacccagtttgtctcagggtt

SEQ ID NO: 10056247 - DNA, 22 bp, Homo sapiens
gcacacacatgtgagtacatgc

SEQ ID NO: 10056248 - DNA, 22 bp, Homo sapiens
gcacacactgttttcctcacat

SEQ ID NO: 10056249 - DNA, 22 bp, Homo sapiens
gcacacacatgtgagtacatgc

SEQ ID NO: 10056250 - DNA, 22 bp, Homo sapiens
gcagaacagtctgtcggttcta

SEQ ID NO: 10056251 - DNA, 22 bp, Homo sapiens
gcagaacatttcacagtatctt

SEQ ID NO: 10056252 - DNA, 22 bp, Homo sapiens
gcactttgcccctcctttggca

SEQ ID NO: 10056253 - DNA, 22 bp, Homo sapiens
gcagagcatgtcctcaggacag

SEQ ID NO: 10056254 - DNA, 22 bp, Homo sapiens
gcagagcagtactctcttgact

SEQ ID NO: 10056255 - DNA, 22 bp, Homo sapiens
gatttgcattctgaaagctacc

SEQ ID NO: 10056256 - DNA, 23 bp, Homo sapiens
gcacaagacctggcagcttccat

SEQ ID NO: 10056257 - DNA, 22 bp, Homo sapiens
gcacaaaaggtacttcatgtag

SEQ ID NO: 10056258 - DNA, 22 bp, Homo sapiens
gcacaaaacacattttgacaat

SEQ ID NO: 10056259 - DNA, 22 bp, Homo sapiens
gcaattatatcaccagagatct

SEQ ID NO: 10056260 - DNA, 17 bp, Homo sapiens
gcaattattgggcattt

SEQ ID NO: 10056261 - DNA, 22 bp, Homo sapiens
gcaaaaaatgcttgttgcttag

SEQ ID NO: 10056262 - DNA, 22 bp, Homo sapiens
gattacattctccttgtattag

SEQ ID NO: 10056263 - DNA, 22 bp, Homo sapiens
gattcaatgttgcagatggaat

SEQ ID NO: 10056264 - DNA, 22 bp, Homo sapiens
gatttataaaggttgcactgga

SEQ ID NO: 10056265 - DNA, 22 bp, Homo sapiens
gatttatagtatgtgctttcag

SEQ ID NO: 10056266 - DNA, 21 bp, Homo sapiens
gatttataagccttaagccta

SEQ ID NO: 10056267 - DNA, 22 bp, Homo sapiens
gatttataaaggttgcactgga

SEQ ID NO: 10056268 - DNA, 22 bp, Homo sapiens
gatttatttttaatcagcaggg

SEQ ID NO: 10056269 - DNA, 22 bp, Homo sapiens
gatttaaagtagacctttgttt

SEQ ID NO: 10056270 - DNA, 22 bp, Homo sapiens
gatggggatgagaagtgagcag

SEQ ID NO: 10056271 - DNA, 22 bp, Homo sapiens
gatgtaaaacctatggagctga

SEQ ID NO: 10056272 - DNA, 22 bp, Homo sapiens
gatggtgtcccaggctcaggct

SEQ ID NO: 10056273 - DNA, 22 bp, Homo sapiens
gatgtctgtctgagccgctgga

SEQ ID NO: 10056274 - DNA, 22 bp, Homo sapiens
gatgtctggctaccactcgcac

SEQ ID NO: 10056275 - DNA, 18 bp, Homo sapiens
gatgggagcaagagaaga

SEQ ID NO: 10056276 - DNA, 22 bp, Homo sapiens
gatgcttcaagcttccttataa

SEQ ID NO: 10056277 - DNA, 22 bp, Homo sapiens
gatgctttccaagaaatcctca

SEQ ID NO: 10056278 - DNA, 22 bp, Homo sapiens
gatgctgtagatgagaacattg

SEQ ID NO: 10056279 - DNA, 22 bp, Homo sapiens
gatgctcatctgtcctttgatg

SEQ ID NO: 10056280 - DNA, 19 bp, Homo sapiens
gatgctcattcaggtggaa

SEQ ID NO: 10056281 - DNA, 22 bp, Homo sapiens
gaggtatcttagagagtgtaga

SEQ ID NO: 10056282 - DNA, 22 bp, Homo sapiens
gaggtcaggcttgcagcagggt

SEQ ID NO: 10056283 - DNA, 22 bp, Homo sapiens
gagtccagacaccatacctgat

SEQ ID NO: 10056284 - DNA, 22 bp, Homo sapiens
gagtccagttgttcacagaggc

SEQ ID NO: 10056285 - DNA, 22 bp, Homo sapiens
gaggggcacagtaaagggtccc

SEQ ID NO: 10056286 - DNA, 22 bp, Homo sapiens
gagctggaagtctgtggtcaga

SEQ ID NO: 10056287 - DNA, 22 bp, Homo sapiens
gagctggcacagaaggatctta

SEQ ID NO: 10056288 - DNA, 22 bp, Homo sapiens
gagctggccgcagagagggcag

SEQ ID NO: 10056289 - DNA, 22 bp, Homo sapiens
gagctggcctcaggcacaggag

SEQ ID NO: 10056290 - DNA, 22 bp, Homo sapiens
gagctggctgtggttgagtgca

SEQ ID NO: 10056291 - DNA, 22 bp, Homo sapiens
gaggacacctcacagcctcaca

SEQ ID NO: 10056292 - DNA, 22 bp, Homo sapiens
gaggagggagctggaagctctt

SEQ ID NO: 10056293 - DNA, 22 bp, Homo sapiens
gaggaggctgtttctctgcatt

SEQ ID NO: 10056294 - DNA, 22 bp, Homo sapiens
gaggagggttggccttaggtag

SEQ ID NO: 10056295 - DNA, 22 bp, Homo sapiens
gaggcagctgggctggtggttt

SEQ ID NO: 10056296 - DNA, 22 bp, Homo sapiens
gagttctggtcagcagggcagc

SEQ ID NO: 10056297 - DNA, 22 bp, Homo sapiens
gagtgtgtcggtcagcgtggcg

SEQ ID NO: 10056298 - DNA, 22 bp, Homo sapiens
gagtgtgttctttatgctgtga

SEQ ID NO: 10056299 - DNA, 22 bp, Homo sapiens
gagtgttcccacaccccagttg

SEQ ID NO: 10056300 - DNA, 22 bp, Homo sapiens
gagtgtgggcacgggggccttg

SEQ ID NO: 10056301 - DNA, 22 bp, Homo sapiens
gagtggggtctgggcatcagtc

SEQ ID NO: 10056302 - DNA, 22 bp, Homo sapiens
gagtggggtctgggcatcagtc

SEQ ID NO: 10056303 - DNA, 22 bp, Homo sapiens
gagtggggggtccgtctcagtg

SEQ ID NO: 10056304 - DNA, 22 bp, Homo sapiens
gagtgtatggaaggaagagatt

SEQ ID NO: 10056305 - DNA, 22 bp, Homo sapiens
gagtggtaatgagcagattagg

SEQ ID NO: 10056306 - DNA, 22 bp, Homo sapiens
gataaaatatgtggcctttagt

SEQ ID NO: 10056307 - DNA, 22 bp, Homo sapiens
gataaaataactatggaatact

SEQ ID NO: 10056308 - DNA, 22 bp, Homo sapiens
gataaaattcttattttacccg

SEQ ID NO: 10056309 - DNA, 22 bp, Homo sapiens
gataaagggggaccaaatgact

SEQ ID NO: 10056310 - DNA, 22 bp, Homo sapiens
gagtttgatagagaggaaccgg

SEQ ID NO: 10056311 - DNA, 22 bp, Homo sapiens
gagtgagttggaaaacagacac

SEQ ID NO: 10056312 - DNA, 22 bp, Homo sapiens
gagtgagtagctacagttttta

SEQ ID NO: 10056313 - DNA, 22 bp, Homo sapiens
gagtcttctgagttattggata

SEQ ID NO: 10056314 - DNA, 22 bp, Homo sapiens
gagtcctttgttccttgccaca

SEQ ID NO: 10056315 - DNA, 22 bp, Homo sapiens
gagtccttggcatcatcagtac

SEQ ID NO: 10056316 - DNA, 22 bp, Homo sapiens
gagtccttgacacatagtaggt

SEQ ID NO: 10056317 - DNA, 22 bp, Homo sapiens
gagtccttccagcaggcattta

SEQ ID NO: 10056318 - DNA, 22 bp, Homo sapiens
gagtccttccagcaggcattta

SEQ ID NO: 10056319 - DNA, 22 bp, Homo sapiens
gagtccttttcatagcagtggg

SEQ ID NO: 10056320 - DNA, 22 bp, Homo sapiens
gagtcgagcagaaagccgtcgg

SEQ ID NO: 10056321 - DNA, 20 bp, Homo sapiens
gagtccttatgggctgaggt

SEQ ID NO: 10056322 - DNA, 22 bp, Homo sapiens
gagtggcagaactgggggtcct

SEQ ID NO: 10056323 - DNA, 20 bp, Homo sapiens
gagtgctttggcttgctctc

SEQ ID NO: 10056324 - DNA, 20 bp, Homo sapiens
gagtgctttggcttgctctc

SEQ ID NO: 10056325 - DNA, 22 bp, Homo sapiens
gagtggggctttaaaggctcag

SEQ ID NO: 10056326 - DNA, 22 bp, Homo sapiens
gagtgcagtatgagaggctgct

SEQ ID NO: 10056327 - DNA, 22 bp, Homo sapiens
gagtgctgctaatgcaagggtg

SEQ ID NO: 10056328 - DNA, 19 bp, Homo sapiens
gatctttgccaatttaagc

SEQ ID NO: 10056329 - DNA, 22 bp, Homo sapiens
gatcttttcagaatttatcagt

SEQ ID NO: 10056330 - DNA, 22 bp, Homo sapiens
gatgaaaaaagacgagcatata

SEQ ID NO: 10056331 - DNA, 22 bp, Homo sapiens
gatcttttcagtcttggtagtt

SEQ ID NO: 10056332 - DNA, 22 bp, Homo sapiens
gatcttttcaggtttctctagt

SEQ ID NO: 10056333 - DNA, 22 bp, Homo sapiens
gatgaaaatcttgagatgtcga

SEQ ID NO: 10056334 - DNA, 22 bp, Homo sapiens
gatgaaaaaagacgagcatata

SEQ ID NO: 10056335 - DNA, 22 bp, Homo sapiens
gatgaaaaattgctgtgtcata

SEQ ID NO: 10056336 - DNA, 22 bp, Homo sapiens
gatgacttatgtttacaaatgt

SEQ ID NO: 10056337 - DNA, 22 bp, Homo sapiens
gatgcaaagataaaacagacgc

SEQ ID NO: 10056338 - DNA, 22 bp, Homo sapiens
gatgcaaaccttacatggacct

SEQ ID NO: 10056339 - DNA, 22 bp, Homo sapiens
gatgcaaactgtgacatagagt

SEQ ID NO: 10056340 - DNA, 22 bp, Homo sapiens
gatagtcacctcccttaacttt

SEQ ID NO: 10056341 - DNA, 22 bp, Homo sapiens
gatagaaagaatatagattcca

SEQ ID NO: 10056342 - DNA, 22 bp, Homo sapiens
gatacacaagtggaaggagacg

SEQ ID NO: 10056343 - DNA, 22 bp, Homo sapiens
gatacacacccttgataggact

SEQ ID NO: 10056344 - DNA, 20 bp, Homo sapiens
gatacacagcacagagggcc

SEQ ID NO: 10056345 - DNA, 22 bp, Homo sapiens
gataactacacttaagacaacc

SEQ ID NO: 10056346 - DNA, 22 bp, Homo sapiens
gatacattccatttctacttaa

SEQ ID NO: 10056347 - DNA, 19 bp, Homo sapiens
gatcagagtgtcagcttgt

SEQ ID NO: 10056348 - DNA, 22 bp, Homo sapiens
gatcaacaacttttgaatagct

SEQ ID NO: 10056349 - DNA, 22 bp, Homo sapiens
gatatttacattaagcacattg

SEQ ID NO: 10056350 - DNA, 22 bp, Homo sapiens
ctttatatccagatgtttggtg

SEQ ID NO: 10056351 - DNA, 22 bp, Homo sapiens
ctttatatattcccaggctgcc

SEQ ID NO: 10056352 - DNA, 22 bp, Homo sapiens
ctttatctgtgtcctcttgcct

SEQ ID NO: 10056353 - DNA, 22 bp, Homo sapiens
ctttatgaacctgttcagcttg

SEQ ID NO: 10056354 - DNA, 22 bp, Homo sapiens
ctttgtattcatccgtaataat

SEQ ID NO: 10056355 - DNA, 22 bp, Homo sapiens
ctttgtattcagttgggctgtg

SEQ ID NO: 10056356 - DNA, 22 bp, Homo sapiens
ctttacaacctaagttgaagct

SEQ ID NO: 10056357 - DNA, 22 bp, Homo sapiens
cttctttgtgcctattggtgac

SEQ ID NO: 10056358 - DNA, 22 bp, Homo sapiens
cttctttactttctagaaataa

SEQ ID NO: 10056359 - DNA, 22 bp, Homo sapiens
cttctttagggatctcttgctg

SEQ ID NO: 10056360 - DNA, 22 bp, Homo sapiens
cttgaaaaatatgccttgcttc

SEQ ID NO: 10056361 - DNA, 22 bp, Homo sapiens
cttgaaaataagaaagactttc

SEQ ID NO: 10056362 - DNA, 22 bp, Homo sapiens
cttgaaaataagaaagactttc

SEQ ID NO: 10056363 - DNA, 22 bp, Homo sapiens
cttctcggccgtgtggatgcgc

SEQ ID NO: 10056364 - DNA, 22 bp, Homo sapiens
ctggctggttccctgctccagg

SEQ ID NO: 10056365 - DNA, 22 bp, Homo sapiens
ctggctggagctgttgtaggct

SEQ ID NO: 10056366 - DNA, 22 bp, Homo sapiens
ctggctggggtaccagttgaac

SEQ ID NO: 10056367 - DNA, 22 bp, Homo sapiens
ctggctggggtaccagttgaac

SEQ ID NO: 10056368 - DNA, 22 bp, Homo sapiens
ctggctgggagctcgcctgcgg

SEQ ID NO: 10056369 - DNA, 22 bp, Homo sapiens
ctggctggtagaattgtgacct

SEQ ID NO: 10056370 - DNA, 22 bp, Homo sapiens
ctggctggtaatggaacgacag

SEQ ID NO: 10056371 - DNA, 22 bp, Homo sapiens
ctggctggtcctcggggacagc

SEQ ID NO: 10056372 - DNA, 22 bp, Homo sapiens
gaaataattctgtgtctgaaca

SEQ ID NO: 10056373 - DNA, 22 bp, Homo sapiens
gaaataatttagaaggtattcc

SEQ ID NO: 10056374 - DNA, 22 bp, Homo sapiens
gaaataatttagaaggtattcc

SEQ ID NO: 10056375 - DNA, 22 bp, Homo sapiens
gaaataatacagtgctcttctc

SEQ ID NO: 10056376 - DNA, 22 bp, Homo sapiens
gaacacagtcaagggctgctgt

SEQ ID NO: 10056377 - DNA, 22 bp, Homo sapiens
gaacacagtcaagggctgctgt

SEQ ID NO: 10056378 - DNA, 22 bp, Homo sapiens
gaaattgtgcatttagcaacac

SEQ ID NO: 10056379 - DNA, 22 bp, Homo sapiens
gaacagatgggctcagatcctg

SEQ ID NO: 10056380 - DNA, 22 bp, Homo sapiens
gaacctgcttccttttatatta

SEQ ID NO: 10056381 - DNA, 22 bp, Homo sapiens
gaactatatcttcaagaaaatg

SEQ ID NO: 10056382 - DNA, 21 bp, Homo sapiens
gaaaagcaagggagtagaaca

SEQ ID NO: 10056383 - DNA, 22 bp, Homo sapiens
gaaaagctaggccagttcagct

SEQ ID NO: 10056384 - DNA, 22 bp, Homo sapiens
gaaaaggaaatttatagagatc

SEQ ID NO: 10056385 - DNA, 22 bp, Homo sapiens
gaaaagtaaacactaggggtca

SEQ ID NO: 10056386 - DNA, 22 bp, Homo sapiens
ctttgttatctgtaaatggtta

SEQ ID NO: 10056387 - DNA, 22 bp, Homo sapiens
ctttgtgtctgttaataattat

SEQ ID NO: 10056388 - DNA, 22 bp, Homo sapiens
cttttaatgggagcagtatttg

SEQ ID NO: 10056389 - DNA, 19 bp, Homo sapiens
gaaaggctgctgctacctg

SEQ ID NO: 10056390 - DNA, 22 bp, Homo sapiens
gaaaatacaaatagccttgaaa

SEQ ID NO: 10056391 - DNA, 22 bp, Homo sapiens
gaaaatacaaatagccttgaaa

SEQ ID NO: 10056392 - DNA, 18 bp, Homo sapiens
gaaaatactctgggctca

SEQ ID NO: 10056393 - DNA, 18 bp, Homo sapiens
gaaaatactctgggctca

SEQ ID NO: 10056394 - DNA, 18 bp, Homo sapiens
gaaaatactctgggctca

SEQ ID NO: 10056395 - DNA, 22 bp, Homo sapiens
gacccagaggcctgacagtgtg

SEQ ID NO: 10056396 - DNA, 22 bp, Homo sapiens
gacccagcttaagtcacatgtt

SEQ ID NO: 10056397 - DNA, 22 bp, Homo sapiens
gacccagggtatccagagctgc

SEQ ID NO: 10056398 - DNA, 22 bp, Homo sapiens
gaccagtcattactcatgccct

SEQ ID NO: 10056399 - DNA, 22 bp, Homo sapiens
gacaggcagacctgtgccctgg

SEQ ID NO: 10056400 - DNA, 21 bp, Homo sapiens
gacaggcaaggagtcacttag

SEQ ID NO: 10056401 - DNA, 22 bp, Homo sapiens
gactgtacttgagagaggaact

SEQ ID NO: 10056402 - DNA, 22 bp, Homo sapiens
gactggtaaggtattggaattc

SEQ ID NO: 10056403 - DNA, 22 bp, Homo sapiens
gactgtggcagaaatgttgttg

SEQ ID NO: 10056404 - DNA, 22 bp, Homo sapiens
gactgtggcgtagatgctggga

SEQ ID NO: 10056405 - DNA, 22 bp, Homo sapiens
gactgtggctaatggtgttagg

SEQ ID NO: 10056406 - DNA, 22 bp, Homo sapiens
gactgtgggctctgtttgtctt

SEQ ID NO: 10056407 - DNA, 22 bp, Homo sapiens
gactgtgggctccttgagggca

SEQ ID NO: 10056408 - DNA, 22 bp, Homo sapiens
gactgtggggaagcagatgcca

SEQ ID NO: 10056409 - DNA, 22 bp, Homo sapiens
gagacacttgctgtgaggtcgc

SEQ ID NO: 10056410 - DNA, 22 bp, Homo sapiens
gagacacagttatcaggcatac

SEQ ID NO: 10056411 - DNA, 22 bp, Homo sapiens
gagacacaggcacagaagaggc

SEQ ID NO: 10056412 - DNA, 22 bp, Homo sapiens
gagacacagttatcaggcatac

SEQ ID NO: 10056413 - DNA, 22 bp, Homo sapiens
gagacacaggtggttcctgtca

SEQ ID NO: 10056414 - DNA, 22 bp, Homo sapiens
gagacacagagaggctgtgtga

SEQ ID NO: 10056415 - DNA, 22 bp, Homo sapiens
gagacacagagaggctgtgtga

SEQ ID NO: 10056416 - DNA, 22 bp, Homo sapiens
gagacacaggcacagaagaggc

SEQ ID NO: 10056417 - DNA, 18 bp, Homo sapiens
gagacacaagggcctgga

SEQ ID NO: 10056418 - DNA, 22 bp, Homo sapiens
gagacacaagacgcaactctgt

SEQ ID NO: 10056419 - DNA, 22 bp, Homo sapiens
gagacacaagaagacatgcaca

SEQ ID NO: 10056420 - DNA, 22 bp, Homo sapiens
gagacacaagaagacatgcaca

SEQ ID NO: 10056421 - DNA, 18 bp, Homo sapiens
gagacacaagggcctgga

SEQ ID NO: 10056422 - DNA, 22 bp, Homo sapiens
gagacacaatttccccatccta

SEQ ID NO: 10056423 - DNA, 22 bp, Homo sapiens
gagacacaatttccccatccta

SEQ ID NO: 10056424 - DNA, 22 bp, Homo sapiens
gagacacacccaaggttatgag

SEQ ID NO: 10056425 - DNA, 22 bp, Homo sapiens
gagacacacccaaggttatgag

SEQ ID NO: 10056426 - DNA, 22 bp, Homo sapiens
gagacacacattctggagagaa

SEQ ID NO: 10056427 - DNA, 22 bp, Homo sapiens
gagacacacattctggagagaa

SEQ ID NO: 10056428 - DNA, 22 bp, Homo sapiens
gagacacacacaggaggtggca

SEQ ID NO: 10056429 - DNA, 22 bp, Homo sapiens
gagacacaagaagacatgcaca

SEQ ID NO: 10056430 - DNA, 22 bp, Homo sapiens
gactttattttaacggagattc

SEQ ID NO: 10056431 - DNA, 22 bp, Homo sapiens
gactttatttccttatttgtga

SEQ ID NO: 10056432 - DNA, 22 bp, Homo sapiens
gactttattcgttaactgttaa

SEQ ID NO: 10056433 - DNA, 22 bp, Homo sapiens
gactttattatagtggcaatag

SEQ ID NO: 10056434 - DNA, 22 bp, Homo sapiens
gactttatcttgtccttcctgc

SEQ ID NO: 10056435 - DNA, 22 bp, Homo sapiens
gactttatgaagagatgaccaa

SEQ ID NO: 10056436 - DNA, 22 bp, Homo sapiens
gactttattactaaccctgtga

SEQ ID NO: 10056437 - DNA, 22 bp, Homo sapiens
gactttatcctgcctgaccacg

SEQ ID NO: 10056438 - DNA, 22 bp, Homo sapiens
gactttataaatgagaggcgga

SEQ ID NO: 10056439 - DNA, 22 bp, Homo sapiens
gagagtctaggaacctcatata

SEQ ID NO: 10056440 - DNA, 20 bp, Homo sapiens
gagagctggggatgaggctg

SEQ ID NO: 10056441 - DNA, 22 bp, Homo sapiens
gagagctggccagcttcagtat

SEQ ID NO: 10056442 - DNA, 22 bp, Homo sapiens
gagagctggagttatttctctg

SEQ ID NO: 10056443 - DNA, 22 bp, Homo sapiens
gagagctgggctttgggtgaag

SEQ ID NO: 10056444 - DNA, 22 bp, Homo sapiens
gagacagatctcggctccatgc

SEQ ID NO: 10056445 - DNA, 18 bp, Homo sapiens
gagagctgctacctagct

SEQ ID NO: 10056446 - DNA, 22 bp, Homo sapiens
gagagctgcaaggtagggcggg

SEQ ID NO: 10056447 - DNA, 22 bp, Homo sapiens
gagagctgcagccgagaggggg

SEQ ID NO: 10056448 - DNA, 22 bp, Homo sapiens
gagagctgcagccgagaggggg

SEQ ID NO: 10056449 - DNA, 22 bp, Homo sapiens
gaaggcctgtggtagtgagacg

SEQ ID NO: 10056450 - DNA, 22 bp, Homo sapiens
gaattacatgaccctgagtaga

SEQ ID NO: 10056451 - DNA, 22 bp, Homo sapiens
gaattacattgttagccttcct

SEQ ID NO: 10056452 - DNA, 22 bp, Homo sapiens
gaattacatttgtgttactgca

SEQ ID NO: 10056453 - DNA, 22 bp, Homo sapiens
gaattcagttatctaattcaag

SEQ ID NO: 10056454 - DNA, 22 bp, Homo sapiens
gaagttatcaggattaaagttg

SEQ ID NO: 10056455 - DNA, 22 bp, Homo sapiens
gaattctggttttgaaatgaat

SEQ ID NO: 10056456 - DNA, 22 bp, Homo sapiens
gaattctggtcctgtccaaggt

SEQ ID NO: 10056457 - DNA, 22 bp, Homo sapiens
gaattctgtcgcttactagatg

SEQ ID NO: 10056458 - DNA, 22 bp, Homo sapiens
gaattctgggagagatctgaca

SEQ ID NO: 10056459 - DNA, 22 bp, Homo sapiens
gacacaggggggcgctagaaga

SEQ ID NO: 10056460 - DNA, 22 bp, Homo sapiens
gacacagatatctctgagatta

SEQ ID NO: 10056461 - DNA, 22 bp, Homo sapiens
gacacagatgatcaggtgtgga

SEQ ID NO: 10056462 - DNA, 22 bp, Homo sapiens
gacacagcttgatgagggcttt

SEQ ID NO: 10056463 - DNA, 22 bp, Homo sapiens
gacacagagtattttaagtact

SEQ ID NO: 10056464 - DNA, 22 bp, Homo sapiens
gacacagagctcacagtctcct

SEQ ID NO: 10056465 - DNA, 22 bp, Homo sapiens
gacacagagataggcctgtgtt

SEQ ID NO: 10056466 - DNA, 20 bp, Homo sapiens
gacacaggcagtcctcagag

SEQ ID NO: 10056467 - DNA, 23 bp, Homo sapiens
gacacaggagcacccagctgagc

SEQ ID NO: 10056468 - DNA, 18 bp, Homo sapiens
gacacaggagagagtccc

SEQ ID NO: 10056469 - DNA, 22 bp, Homo sapiens
ttgagttctgtgtatcctttgt

SEQ ID NO: 10056470 - DNA, 22 bp, Homo sapiens
ttgagttctggtcttttaaaag

SEQ ID NO: 10056471 - DNA, 22 bp, Homo sapiens
ttgactgtgatgggctcagctg

SEQ ID NO: 10056472 - DNA, 22 bp, Homo sapiens
ttgacctatgtttcttcatctg

SEQ ID NO: 10056473 - DNA, 19 bp, Homo sapiens
ttgacgttgtggaattaac

SEQ ID NO: 10056474 - DNA, 22 bp, Homo sapiens
ttgagaaacctggcagtagaga

SEQ ID NO: 10056475 - DNA, 22 bp, Homo sapiens
ttgagctgtatacctatgactg

SEQ ID NO: 10056476 - DNA, 22 bp, Homo sapiens
ttcttgttctcctcatttagag

SEQ ID NO: 10056477 - DNA, 22 bp, Homo sapiens
ttcttgtaatttggagaaatga

SEQ ID NO: 10056478 - DNA, 22 bp, Homo sapiens
ttcttgtatgtatgcaaaatca

SEQ ID NO: 10056479 - DNA, 22 bp, Homo sapiens
ttcttgtactggagatacatga

SEQ ID NO: 10056480 - DNA, 22 bp, Homo sapiens
ttcttgtatataaaaatcattt

SEQ ID NO: 10056481 - DNA, 17 bp, Homo sapiens
ctcagcagggctcactt

SEQ ID NO: 10056482 - DNA, 22 bp, Homo sapiens
ctatttttctgtaccctaattt

SEQ ID NO: 10056483 - DNA, 21 bp, Homo sapiens
ctagcccctactccaagttga

SEQ ID NO: 10056484 - DNA, 22 bp, Homo sapiens
ttccttttcttaaacatatgtg

SEQ ID NO: 10056485 - DNA, 22 bp, Homo sapiens
ctattcagcctctaagacaagt

SEQ ID NO: 10056486 - DNA, 22 bp, Homo sapiens
ctattcagtaagccaaaaccat

SEQ ID NO: 10056487 - DNA, 22 bp, Homo sapiens
ctattcagttgtgggcaacaat

SEQ ID NO: 10056488 - DNA, 23 bp, Homo sapiens
ctagggcagtatttcacagacac

SEQ ID NO: 10056489 - DNA, 22 bp, Homo sapiens
ctaattatgttgttataatcaa

SEQ ID NO: 10056490 - DNA, 22 bp, Homo sapiens
ctacaaaagtaattgtggtttt

SEQ ID NO: 10056491 - DNA, 22 bp, Homo sapiens
ctaataacatgaactactttct

SEQ ID NO: 10056492 - DNA, 22 bp, Homo sapiens
ctaagtcatggaaagtgtgtgt

SEQ ID NO: 10056493 - DNA, 22 bp, Homo sapiens
ctaataatagaggtggcatttg

SEQ ID NO: 10056494 - DNA, 22 bp, Homo sapiens
ctaatagataccacattggaca

SEQ ID NO: 10056495 - DNA, 22 bp, Homo sapiens
ttccttccagcttgtgacagtc

SEQ ID NO: 10056496 - DNA, 22 bp, Homo sapiens
ttccttcagttcagggaaccct

SEQ ID NO: 10056497 - DNA, 22 bp, Homo sapiens
ttcccttcctcactctacttgt

SEQ ID NO: 10056498 - DNA, 22 bp, Homo sapiens
ttcccttctagttttgagagac

SEQ ID NO: 10056499 - DNA, 22 bp, Homo sapiens
ttccaaactgccaattcagaag

SEQ ID NO: 10056500 - DNA, 22 bp, Homo sapiens
ttccaaagaaattgaccaagac

SEQ ID NO: 10056501 - DNA, 22 bp, Homo sapiens
cgctgggggaacagcgagggtg

SEQ ID NO: 10056502 - DNA, 22 bp, Homo sapiens
cggctgctgcctgagtcgctgt

SEQ ID NO: 10056503 - DNA, 22 bp, Homo sapiens
cggctggggctgtccccatgac

SEQ ID NO: 10056504 - DNA, 23 bp, Homo sapiens
cggctgctcggccgagtcctcgg

SEQ ID NO: 10056505 - DNA, 22 bp, Homo sapiens
ttcagaaaaagaccattgcaat

SEQ ID NO: 10056506 - DNA, 22 bp, Homo sapiens
ttcagaaacatcagtggatgga

SEQ ID NO: 10056507 - DNA, 20 bp, Homo sapiens
ctctcacagctccctcagcc

SEQ ID NO: 10056508 - DNA, 22 bp, Homo sapiens
ctctccactgtcctttgctggt

SEQ ID NO: 10056509 - DNA, 22 bp, Homo sapiens
ctctcctccaacagccctgccg

SEQ ID NO: 10056510 - DNA, 22 bp, Homo sapiens
ctctcctccaggaactcacagt

SEQ ID NO: 10056511 - DNA, 22 bp, Homo sapiens
ctctcctcagaacaggccctct

SEQ ID NO: 10056512 - DNA, 22 bp, Homo sapiens
tttcagttcagtttattatatc

SEQ ID NO: 10056513 - DNA, 22 bp, Homo sapiens
tttcagttagctgagacccagg

SEQ ID NO: 10056514 - DNA, 22 bp, Homo sapiens
tttcagttgtcctgttaatagc

SEQ ID NO: 10056515 - DNA, 22 bp, Homo sapiens
tttaaatttagaagaaacactg

SEQ ID NO: 10056516 - DNA, 22 bp, Homo sapiens
tttaaaaggggtattaagtcca

SEQ ID NO: 10056517 - DNA, 22 bp, Homo sapiens
tttaaaaaactagtctgagtct

SEQ ID NO: 10056518 - DNA, 22 bp, Homo sapiens
tttacattgcattaggtattat

SEQ ID NO: 10056519 - DNA, 22 bp, Homo sapiens
ctcctctttacccgcatggtct

SEQ ID NO: 10056520 - DNA, 22 bp, Homo sapiens
ctcctctttggggatttacaca

SEQ ID NO: 10056521 - DNA, 22 bp, Homo sapiens
ttgcttttccctgtctctgatt

SEQ ID NO: 10056522 - DNA, 22 bp, Homo sapiens
ttgcttttgtgtgctctctgga

SEQ ID NO: 10056523 - DNA, 22 bp, Homo sapiens
ttgctttgccaccagaagtcta

SEQ ID NO: 10056524 - DNA, 22 bp, Homo sapiens
ctcatacatatgccattcctgc

SEQ ID NO: 10056525 - DNA, 22 bp, Homo sapiens
ctcataaggagctcacaaccta

SEQ ID NO: 10056526 - DNA, 22 bp, Homo sapiens
tttaaaaaactagtctgagtct

SEQ ID NO: 10056527 - DNA, 22 bp, Homo sapiens
ctccagtgagtgagcaggcgac

SEQ ID NO: 10056528 - DNA, 22 bp, Homo sapiens
ttgtgtacacgcctttaaatga

SEQ ID NO: 10056529 - DNA, 22 bp, Homo sapiens
ttgtattttgttatgctactgc

SEQ ID NO: 10056530 - DNA, 22 bp, Homo sapiens
ctccagggttccccgatccact

SEQ ID NO: 10056531 - DNA, 22 bp, Homo sapiens
ttgtatttcttccggtctcatt

SEQ ID NO: 10056532 - DNA, 22 bp, Homo sapiens
ttgtatttgggtagtatagaga

SEQ ID NO: 10056533 - DNA, 22 bp, Homo sapiens
ttgtatttgattgtcatatcgt

SEQ ID NO: 10056534 - DNA, 22 bp, Homo sapiens
ctccagggcagcatggcagtgg

SEQ ID NO: 10056535 - DNA, 20 bp, Homo sapiens
ctccaggggaagagccttcc

SEQ ID NO: 10056536 - DNA, 22 bp, Homo sapiens
ctccaggggccagaagcctggc

SEQ ID NO: 10056537 - DNA, 22 bp, Homo sapiens
ttgggtaggattcagcagtgtg

SEQ ID NO: 10056538 - DNA, 22 bp, Homo sapiens
ttgggtagcagcagggctcgat

SEQ ID NO: 10056539 - DNA, 22 bp, Homo sapiens
ttggtatttcctcaggcatgtc

SEQ ID NO: 10056540 - DNA, 22 bp, Homo sapiens
ctccagggagctgcgggagcca

SEQ ID NO: 10056541 - DNA, 22 bp, Homo sapiens
ctccagggagctgtggaggttt

SEQ ID NO: 10056542 - DNA, 22 bp, Homo sapiens
ctccagggaggagcacgggttc

SEQ ID NO: 10056543 - DNA, 22 bp, Homo sapiens
ctctgggcaggacgccaggcct

SEQ ID NO: 10056544 - DNA, 22 bp, Homo sapiens
ctctgggcggcccaggccaacc

SEQ ID NO: 10056545 - DNA, 22 bp, Homo sapiens
ctctcctcccatgtaggagatg

SEQ ID NO: 10056546 - DNA, 22 bp, Homo sapiens
ctctcctctgaagtggtgaccc

SEQ ID NO: 10056547 - DNA, 22 bp, Homo sapiens
ctctggtgtcctttagaattta

SEQ ID NO: 10056548 - DNA, 17 bp, Homo sapiens
ctcttttgtcttcttcc

SEQ ID NO: 10056549 - DNA, 22 bp, Homo sapiens
ttttgttttcttagaaacctgg

SEQ ID NO: 10056550 - DNA, 22 bp, Homo sapiens
ctgaagaaatatgattgcttaa

SEQ ID NO: 10056551 - DNA, 22 bp, Homo sapiens
ctgagagaaacatgactcagga

SEQ ID NO: 10056552 - DNA, 22 bp, Homo sapiens
ctgcagagcatgaggaggtctg

SEQ ID NO: 10056553 - DNA, 22 bp, Homo sapiens
ctgattccaaagccaaagctat

SEQ ID NO: 10056554 - DNA, 22 bp, Homo sapiens
ctgatcctcctttaagtagctg

SEQ ID NO: 10056555 - DNA, 22 bp, Homo sapiens
ctgatgcttgcaacaaagaacc

SEQ ID NO: 10056556 - DNA, 22 bp, Homo sapiens
ctgcctagaaaaccaggctcct

SEQ ID NO: 10056557 - DNA, 22 bp, Homo sapiens
ctgccatgcagttagtccctca

SEQ ID NO: 10056558 - DNA, 22 bp, Homo sapiens
ctgcctcctgccgtgcagcttc

SEQ ID NO: 10056559 - DNA, 22 bp, Homo sapiens
ctgcctagggtctggtaccaca

SEQ ID NO: 10056560 - DNA, 22 bp, Homo sapiens
ctgcagcagaataatctgctca

SEQ ID NO: 10056561 - DNA, 22 bp, Homo sapiens
ctgcagcagcctccagccttgg

SEQ ID NO: 10056562 - DNA, 22 bp, Homo sapiens
ctgcagcaggaggctcctgcag

SEQ ID NO: 10056563 - DNA, 22 bp, Homo sapiens
ctgcagaggggttgaagggtcc

SEQ ID NO: 10056564 - DNA, 22 bp, Homo sapiens
ctgcagagctttctgaatgaag

SEQ ID NO: 10056565 - DNA, 22 bp, Homo sapiens
ctgccaggggcctcacaggcca

SEQ ID NO: 10056566 - DNA, 22 bp, Homo sapiens
ctgcagccacgagtcacagccc

SEQ ID NO: 10056567 - DNA, 22 bp, Homo sapiens
ctgcagcagtgtgtctcatttt

SEQ ID NO: 10056568 - DNA, 22 bp, Homo sapiens
ctggcaccaggcatgctgggag

SEQ ID NO: 10056569 - DNA, 22 bp, Homo sapiens
ctggcaagaaatatatatctta

SEQ ID NO: 10056570 - DNA, 22 bp, Homo sapiens
ctggcctgaggccgccttcaga

SEQ ID NO: 10056571 - DNA, 22 bp, Homo sapiens
ctggcctgagcacagcggctgc

SEQ ID NO: 10056572 - DNA, 22 bp, Homo sapiens
ctggcctggcagggagggcatg

SEQ ID NO: 10056573 - DNA, 22 bp, Homo sapiens
ctggcctgcagatcccagggtc

SEQ ID NO: 10056574 - DNA, 22 bp, Homo sapiens
ctggcctggggcctcagctgct

SEQ ID NO: 10056575 - DNA, 22 bp, Homo sapiens
ctggagggggaaatgttcattg

SEQ ID NO: 10056576 - DNA, 22 bp, Homo sapiens
ctggaggtaatgttatttttgt

SEQ ID NO: 10056577 - DNA, 22 bp, Homo sapiens
ctggaggaataatggcatcttg

SEQ ID NO: 10056578 - DNA, 22 bp, Homo sapiens
ctgctttatctgagacaagtca

SEQ ID NO: 10056579 - DNA, 22 bp, Homo sapiens
ctgctttatagggcttccatgt

SEQ ID NO: 10056580 - DNA, 22 bp, Homo sapiens
ctgctttaggtggaatgttcta

SEQ ID NO: 10056581 - DNA, 22 bp, Homo sapiens
ctgctttagacaactgctggga

SEQ ID NO: 10056582 - DNA, 22 bp, Homo sapiens
ctgcctggacagctcttacctt

SEQ ID NO: 10056583 - DNA, 22 bp, Homo sapiens
ctgcctggaccggcagccctcc

SEQ ID NO: 10056584 - DNA, 22 bp, Homo sapiens
ctgcctggatgaatggcgcctt

SEQ ID NO: 10056585 - DNA, 22 bp, Homo sapiens
ctggacagaaaaggccactgga

SEQ ID NO: 10056586 - DNA, 16 bp, Homo sapiens
ctggacagaaaaacct

SEQ ID NO: 10056587 - DNA, 22 bp, Homo sapiens
ctggacagaaaccagtcctggg

SEQ ID NO: 10056588 - DNA, 22 bp, Homo sapiens
ctggacaggctggggactgcaa

SEQ ID NO: 10056589 - DNA, 22 bp, Homo sapiens
ctgcttttgagcccagtgctca

SEQ ID NO: 10056590 - DNA, 22 bp, Homo sapiens
ctgctttttgtaggtcccagag

SEQ ID NO: 10056591 - DNA, 22 bp, Homo sapiens
ctgctttgaaaataaacttgtc

SEQ ID NO: 10056592 - DNA, 22 bp, Homo sapiens
ctgctttgtggaatcacactgg

SEQ ID NO: 10056593 - DNA, 22 bp, Homo sapiens
cctggcaggctggggacagtgc

SEQ ID NO: 10056594 - DNA, 22 bp, Homo sapiens
tgtctctggcccatgagcagag

SEQ ID NO: 10056595 - DNA, 22 bp, Homo sapiens
tgtctctgggtgattcagtcct

SEQ ID NO: 10056596 - DNA, 22 bp, Homo sapiens
tgtctctgtgagatctgacgat

SEQ ID NO: 10056597 - DNA, 22 bp, Homo sapiens
tgtctctgtgcatttgtgcttc

SEQ ID NO: 10056598 - DNA, 22 bp, Homo sapiens
tggtgctcccaagattgttcta

SEQ ID NO: 10056599 - DNA, 17 bp, Homo sapiens
cctgcccagagacagat

SEQ ID NO: 10056600 - DNA, 22 bp, Homo sapiens
tggtggctgttgcagaactgag

SEQ ID NO: 10056601 - DNA, 17 bp, Homo sapiens
tggtggctggagtcagg

SEQ ID NO: 10056602 - DNA, 22 bp, Homo sapiens
tggtggctgtaagggagagaag

SEQ ID NO: 10056603 - DNA, 22 bp, Homo sapiens
tggtggctaccaggtcctgggg

SEQ ID NO: 10056604 - DNA, 22 bp, Homo sapiens
tggtgctgccacctcctctgct

SEQ ID NO: 10056605 - DNA, 22 bp, Homo sapiens
tgtaaacatatcagactttctt

SEQ ID NO: 10056606 - DNA, 22 bp, Homo sapiens
tgtaggagtccaatcaggagac

SEQ ID NO: 10056607 - DNA, 21 bp, Homo sapiens
tgtaggaggcatctggggctg

SEQ ID NO: 10056608 - DNA, 22 bp, Homo sapiens
tgtaaagaaatagcatttgtag

SEQ ID NO: 10056609 - DNA, 22 bp, Homo sapiens
tgtaaagaaagacgcagagtta

SEQ ID NO: 10056610 - DNA, 22 bp, Homo sapiens
tgtaccagatgtctaaagccat

SEQ ID NO: 10056611 - DNA, 22 bp, Homo sapiens
tgtaccaggaggaggacaaatt

SEQ ID NO: 10056612 - DNA, 22 bp, Homo sapiens
cctggaggtggaggttgcagtg

SEQ ID NO: 10056613 - DNA, 22 bp, Homo sapiens
tgtattcaacttcttaaaaatt

SEQ ID NO: 10056614 - DNA, 22 bp, Homo sapiens
tgtattaacattaataaaatgg

SEQ ID NO: 10056615 - DNA, 22 bp, Homo sapiens
tgtattaacattaataaaatgg

SEQ ID NO: 10056616 - DNA, 22 bp, Homo sapiens
tgtgaggtaacgctgctctgtt

SEQ ID NO: 10056617 - DNA, 22 bp, Homo sapiens
tgtctttggaatatttagctga

SEQ ID NO: 10056618 - DNA, 21 bp, Homo sapiens
tgtctttaggacctgttaaat

SEQ ID NO: 10056619 - DNA, 22 bp, Homo sapiens
tgtctttagttgcttagatttg

SEQ ID NO: 10056620 - DNA, 22 bp, Homo sapiens
tgtctttagagtcacaaaacca

SEQ ID NO: 10056621 - DNA, 22 bp, Homo sapiens
tgtctttagccagcagtcttct

SEQ ID NO: 10056622 - DNA, 22 bp, Homo sapiens
tgtctttacttaataaatatac

SEQ ID NO: 10056623 - DNA, 22 bp, Homo sapiens
tgtctttacttagaagttcagg

SEQ ID NO: 10056624 - DNA, 22 bp, Homo sapiens
tgtctttacttagaagttcagg

SEQ ID NO: 10056625 - DNA, 22 bp, Homo sapiens
tgtctttacttagaagttcagg

SEQ ID NO: 10056626 - DNA, 22 bp, Homo sapiens
tgtctttagaaagaagcagaca

SEQ ID NO: 10056627 - DNA, 22 bp, Homo sapiens
tgtctttagaaagaagcagaca

SEQ ID NO: 10056628 - DNA, 22 bp, Homo sapiens
tgtctttagacctctctggcct

SEQ ID NO: 10056629 - DNA, 22 bp, Homo sapiens
tgtctggtgggttgacaggcag

SEQ ID NO: 10056630 - DNA, 22 bp, Homo sapiens
tgtgctggggtccagctgagcc

SEQ ID NO: 10056631 - DNA, 22 bp, Homo sapiens
tgtgctgtcagtatcaagggat

SEQ ID NO: 10056632 - DNA, 22 bp, Homo sapiens
cctgggaagcccatagcagctt

SEQ ID NO: 10056633 - DNA, 22 bp, Homo sapiens
tgtgtgtcagtcttgtttaggg

SEQ ID NO: 10056634 - DNA, 22 bp, Homo sapiens
tgtgtgtataataatgtctgca

SEQ ID NO: 10056635 - DNA, 22 bp, Homo sapiens
cctggggaatagagtcaagggg

SEQ ID NO: 10056636 - DNA, 23 bp, Homo sapiens
tgtgttctcacacagatgcagta

SEQ ID NO: 10056637 - DNA, 22 bp, Homo sapiens
cctggggacctgcctcagccct

SEQ ID NO: 10056638 - DNA, 22 bp, Homo sapiens
tgtgttcatgtatgtatacata

SEQ ID NO: 10056639 - DNA, 22 bp, Homo sapiens
cctgggtgaaatctctcctgca

SEQ ID NO: 10056640 - DNA, 21 bp, Homo sapiens
tgtgtgggcatatctgctgca

SEQ ID NO: 10056641 - DNA, 22 bp, Homo sapiens
tgtggggctgtggtgttcttct

SEQ ID NO: 10056642 - DNA, 22 bp, Homo sapiens
tgtggggcttacaaaggcagat

SEQ ID NO: 10056643 - DNA, 22 bp, Homo sapiens
tgtggggtgtggtccaggcatc

SEQ ID NO: 10056644 - DNA, 22 bp, Homo sapiens
tgtggggccaaagcccagccac

SEQ ID NO: 10056645 - DNA, 22 bp, Homo sapiens
tgtggggcctcgtgctagctgg

SEQ ID NO: 10056646 - DNA, 22 bp, Homo sapiens
tgtggggcagctagccggcctg

SEQ ID NO: 10056647 - DNA, 22 bp, Homo sapiens
tgtggggctccctggcagcctg

SEQ ID NO: 10056648 - DNA, 22 bp, Homo sapiens
tgtggggctgtcaggcaactgg

SEQ ID NO: 10056649 - DNA, 22 bp, Homo sapiens
tgtgctttggttttacaggatg

SEQ ID NO: 10056650 - DNA, 22 bp, Homo sapiens
tgtggcaggaagagcttctgag

SEQ ID NO: 10056651 - DNA, 22 bp, Homo sapiens
tgtggcagctggaggtggagaa

SEQ ID NO: 10056652 - DNA, 22 bp, Homo sapiens
tgtggcagggatactgaggcag

SEQ ID NO: 10056653 - DNA, 20 bp, Homo sapiens
tgtggcaggatgagggcgga

SEQ ID NO: 10056654 - DNA, 22 bp, Homo sapiens
tgtggcaggcattctgaggctg

SEQ ID NO: 10056655 - DNA, 22 bp, Homo sapiens
cctcctggtccagcatctcttt

SEQ ID NO: 10056656 - DNA, 22 bp, Homo sapiens
cctccagcattactggcccatg

SEQ ID NO: 10056657 - DNA, 22 bp, Homo sapiens
cctccacaggagctgcagtgct

SEQ ID NO: 10056658 - DNA, 22 bp, Homo sapiens
cctctcccgggtgccgctgggc

SEQ ID NO: 10056659 - DNA, 22 bp, Homo sapiens
cctctctcttgtagtccctgcc

SEQ ID NO: 10056660 - DNA, 22 bp, Homo sapiens
cctctcctggctgtaggacctc

SEQ ID NO: 10056661 - DNA, 22 bp, Homo sapiens
cctctgggtatctgtggaagta

SEQ ID NO: 10056662 - DNA, 22 bp, Homo sapiens
cctctgggtgggaggccgggcg

SEQ ID NO: 10056663 - DNA, 22 bp, Homo sapiens
tggagctgagaagtggagctct

SEQ ID NO: 10056664 - DNA, 22 bp, Homo sapiens
tggagctgagagccaggctggc

SEQ ID NO: 10056665 - DNA, 22 bp, Homo sapiens
tggagctgagagccaggctggc

SEQ ID NO: 10056666 - DNA, 22 bp, Homo sapiens
ccctccaccaagcagggcgcca

SEQ ID NO: 10056667 - DNA, 22 bp, Homo sapiens
ccctccacagacaggacttgtc

SEQ ID NO: 10056668 - DNA, 17 bp, Homo sapiens
tggcaagacagctcagg

SEQ ID NO: 10056669 - DNA, 22 bp, Homo sapiens
tggatctcggcaatgcgggact

SEQ ID NO: 10056670 - DNA, 18 bp, Homo sapiens
tggagctgagggcaatgc

SEQ ID NO: 10056671 - DNA, 22 bp, Homo sapiens
cctaggctggctgtcttcaggt

SEQ ID NO: 10056672 - DNA, 22 bp, Homo sapiens
cctatacaggcttctttacatg

SEQ ID NO: 10056673 - DNA, 22 bp, Homo sapiens
tggcagcaaaaccagaatcaga

SEQ ID NO: 10056674 - DNA, 22 bp, Homo sapiens
tggcacaggatctcagcggcca

SEQ ID NO: 10056675 - DNA, 22 bp, Homo sapiens
tggcagaggtaattcaaatccc

SEQ ID NO: 10056676 - DNA, 22 bp, Homo sapiens
tggcaaggccacaggtgcagtt

SEQ ID NO: 10056677 - DNA, 22 bp, Homo sapiens
tggcaaggctgtgggggcagag

SEQ ID NO: 10056678 - DNA, 22 bp, Homo sapiens
cccagctcttcaagtcaccccc

SEQ ID NO: 10056679 - DNA, 22 bp, Homo sapiens
cccagctgaacttgcattccaa

SEQ ID NO: 10056680 - DNA, 22 bp, Homo sapiens
cccagctgaacttgcattccaa

SEQ ID NO: 10056681 - DNA, 23 bp, Homo sapiens
cccagctgagacttcctgaactc

SEQ ID NO: 10056682 - DNA, 22 bp, Homo sapiens
cccagctgatttttgcagagat

SEQ ID NO: 10056683 - DNA, 17 bp, Homo sapiens
cccagctggcagtgccg

SEQ ID NO: 10056684 - DNA, 18 bp, Homo sapiens
cccagctggtgggtcagt

SEQ ID NO: 10056685 - DNA, 22 bp, Homo sapiens
cccagcctgtgacagccgtcct

SEQ ID NO: 10056686 - DNA, 21 bp, Homo sapiens
cccaggaggctgagaagagca

SEQ ID NO: 10056687 - DNA, 22 bp, Homo sapiens
tgccaattcgcagtgagtattt

SEQ ID NO: 10056688 - DNA, 22 bp, Homo sapiens
tgcattcaatacagtaagaata

SEQ ID NO: 10056689 - DNA, 22 bp, Homo sapiens
tgcattcatcatttgaaagccc

SEQ ID NO: 10056690 - DNA, 22 bp, Homo sapiens
cccaggatgtcgaggctgcagt

SEQ ID NO: 10056691 - DNA, 21 bp, Homo sapiens
tgccaggcctgagctggggtc

SEQ ID NO: 10056692 - DNA, 22 bp, Homo sapiens
ccccagcccacaagcatattaa

SEQ ID NO: 10056693 - DNA, 22 bp, Homo sapiens
ccccagccttccatgggaattg

SEQ ID NO: 10056694 - DNA, 22 bp, Homo sapiens
tgctggagaggaaggtggggtc

SEQ ID NO: 10056695 - DNA, 22 bp, Homo sapiens
ccccagccagcttgtagtagaa

SEQ ID NO: 10056696 - DNA, 22 bp, Homo sapiens
ccccagccagcaggacctctga

SEQ ID NO: 10056697 - DNA, 22 bp, Homo sapiens
ccccagccagcaggacctctga

SEQ ID NO: 10056698 - DNA, 22 bp, Homo sapiens
ccccactctcggccagataggc

SEQ ID NO: 10056699 - DNA, 19 bp, Homo sapiens
tgctgcaggatgctgctgg

SEQ ID NO: 10056700 - DNA, 22 bp, Homo sapiens
cccccatccatgtcaggagagg

SEQ ID NO: 10056701 - DNA, 22 bp, Homo sapiens
tgcctgggagtgaccaagactc

SEQ ID NO: 10056702 - DNA, 22 bp, Homo sapiens
tgcctgctctgtgccacagttg

SEQ ID NO: 10056703 - DNA, 22 bp, Homo sapiens
tgcctgggaaccaatcctggct

SEQ ID NO: 10056704 - DNA, 22 bp, Homo sapiens
tgcctgggccttcccacctctg

SEQ ID NO: 10056705 - DNA, 22 bp, Homo sapiens
tgcctgggatctgtgccctttg

SEQ ID NO: 10056706 - DNA, 22 bp, Homo sapiens
tgcctgggcctctgaggaaggc

SEQ ID NO: 10056707 - DNA, 22 bp, Homo sapiens
tgctccatgcgctcggccggcg

SEQ ID NO: 10056708 - DNA, 22 bp, Homo sapiens
cccaggctcctgactcattcta

SEQ ID NO: 10056709 - DNA, 22 bp, Homo sapiens
cccaggctcctagaggcccaga

SEQ ID NO: 10056710 - DNA, 22 bp, Homo sapiens
cccagggagcttggagaacggg

SEQ ID NO: 10056711 - DNA, 22 bp, Homo sapiens
caggaaaatctgcccacacaag

SEQ ID NO: 10056712 - DNA, 22 bp, Homo sapiens
caggaaaatctgcccacacaag

SEQ ID NO: 10056713 - DNA, 22 bp, Homo sapiens
cagctttattaatgattgtctt

SEQ ID NO: 10056714 - DNA, 22 bp, Homo sapiens
caggaaagaaatgagaacacca

SEQ ID NO: 10056715 - DNA, 22 bp, Homo sapiens
caggaaacatatgtgcttgagg

SEQ ID NO: 10056716 - DNA, 22 bp, Homo sapiens
cagctgtgtaaacacatgtgta

SEQ ID NO: 10056717 - DNA, 22 bp, Homo sapiens
cagctgtggggagcttgggcca

SEQ ID NO: 10056718 - DNA, 22 bp, Homo sapiens
cagctgtgtaaacacatgtgta

SEQ ID NO: 10056719 - DNA, 22 bp, Homo sapiens
cagctgtgggcctgacgtggca

SEQ ID NO: 10056720 - DNA, 22 bp, Homo sapiens
cagctgtggctgccactgctcc

SEQ ID NO: 10056721 - DNA, 22 bp, Homo sapiens
cagctgtggagggaggaaatgc

SEQ ID NO: 10056722 - DNA, 22 bp, Homo sapiens
cagctgtgatatgcctgcctga

SEQ ID NO: 10056723 - DNA, 22 bp, Homo sapiens
gtgttttggccattagtgtgat

SEQ ID NO: 10056724 - DNA, 20 bp, Homo sapiens
gttaaaagagtaatttgagg

SEQ ID NO: 10056725 - DNA, 22 bp, Homo sapiens
gtgtttggtcagacgtccgggg

SEQ ID NO: 10056726 - DNA, 22 bp, Homo sapiens
gtgtgtgtatatatacacacac

SEQ ID NO: 10056727 - DNA, 20 bp, Homo sapiens
gtgtgtgctccatgcatgct

SEQ ID NO: 10056728 - DNA, 22 bp, Homo sapiens
gtgtgtggcaaactgggcctgc

SEQ ID NO: 10056729 - DNA, 22 bp, Homo sapiens
gtgtgtgctccccaggagagct

SEQ ID NO: 10056730 - DNA, 22 bp, Homo sapiens
gtgtgtgtactctgtatataaa

SEQ ID NO: 10056731 - DNA, 22 bp, Homo sapiens
gtgtgtgtactctgtatataaa

SEQ ID NO: 10056732 - DNA, 22 bp, Homo sapiens
gtttcaaagcacagctcacatt

SEQ ID NO: 10056733 - DNA, 22 bp, Homo sapiens
gtttacatgcagaaaatcaatg

SEQ ID NO: 10056734 - DNA, 20 bp, Homo sapiens
gttggaaagttcactctgct

SEQ ID NO: 10056735 - DNA, 19 bp, Homo sapiens
gttctgtgtcctggaggaa

SEQ ID NO: 10056736 - DNA, 22 bp, Homo sapiens
gttggaaatggtttctatccct

SEQ ID NO: 10056737 - DNA, 22 bp, Homo sapiens
gttggaaatgcagagtctcaga

SEQ ID NO: 10056738 - DNA, 22 bp, Homo sapiens
gtgtacagtaagtgaatctagg

SEQ ID NO: 10056739 - DNA, 22 bp, Homo sapiens
gtgtacagtgatttgagttcac

SEQ ID NO: 10056740 - DNA, 22 bp, Homo sapiens
gtgtacatattgagtctgctga

SEQ ID NO: 10056741 - DNA, 22 bp, Homo sapiens
gtgtatgatttcaaatggctag

SEQ ID NO: 10056742 - DNA, 22 bp, Homo sapiens
gtgtctgctgcaccctcacacc

SEQ ID NO: 10056743 - DNA, 22 bp, Homo sapiens
gtgtctgcaagatagccaagtc

SEQ ID NO: 10056744 - DNA, 22 bp, Homo sapiens
gtgtgaaagttcctaagactat

SEQ ID NO: 10056745 - DNA, 22 bp, Homo sapiens
gtgtgaaagttcctaagactat

SEQ ID NO: 10056746 - DNA, 22 bp, Homo sapiens
cagctgtctggggagtgctcgc

SEQ ID NO: 10056747 - DNA, 22 bp, Homo sapiens
cagctgtctttgcacagtttag

SEQ ID NO: 10056748 - DNA, 22 bp, Homo sapiens
cagctgtctgaagcaggagtcc

SEQ ID NO: 10056749 - DNA, 22 bp, Homo sapiens
cagctggggcagccacgtgcgg

SEQ ID NO: 10056750 - DNA, 22 bp, Homo sapiens
cagctggctggtcagtgcacaa

SEQ ID NO: 10056751 - DNA, 22 bp, Homo sapiens
gtgtgctgcccaactcgcagat

SEQ ID NO: 10056752 - DNA, 19 bp, Homo sapiens
cagctgcaccgtgaccatc

SEQ ID NO: 10056753 - DNA, 22 bp, Homo sapiens
cagctgcagaaagcaagcaggt

SEQ ID NO: 10056754 - DNA, 22 bp, Homo sapiens
cagctgcagatcatgtttacag

SEQ ID NO: 10056755 - DNA, 22 bp, Homo sapiens
cagctgcaggagaaacagaggc

SEQ ID NO: 10056756 - DNA, 22 bp, Homo sapiens
gtggggagtgttctgtgattgg

SEQ ID NO: 10056757 - DNA, 22 bp, Homo sapiens
gtggggcagtggcctgggagca

SEQ ID NO: 10056758 - DNA, 22 bp, Homo sapiens
gtggggcagtggcctgggagca

SEQ ID NO: 10056759 - DNA, 22 bp, Homo sapiens
gtggggcatgcacgctgctcct

SEQ ID NO: 10056760 - DNA, 22 bp, Homo sapiens
cagctgcaggctgtgcaggaag

SEQ ID NO: 10056761 - DNA, 22 bp, Homo sapiens
cagctgcatgtctgtggtggtc

SEQ ID NO: 10056762 - DNA, 22 bp, Homo sapiens
cagctgcattaattttagtgaa

SEQ ID NO: 10056763 - DNA, 22 bp, Homo sapiens
cagctgctgttcagttttgttt

SEQ ID NO: 10056764 - DNA, 22 bp, Homo sapiens
cagctgctgttcagttttgttt

SEQ ID NO: 10056765 - DNA, 22 bp, Homo sapiens
gtgggtggatcatgaggtcagg

SEQ ID NO: 10056766 - DNA, 22 bp, Homo sapiens
cagctggccctttggtagcctt

SEQ ID NO: 10056767 - DNA, 22 bp, Homo sapiens
cagctggccctttggtagcctt

SEQ ID NO: 10056768 - DNA, 22 bp, Homo sapiens
gtggcaggtcccattggagcag

SEQ ID NO: 10056769 - DNA, 21 bp, Homo sapiens
cagcccagcttcttccccagt

SEQ ID NO: 10056770 - DNA, 21 bp, Homo sapiens
cagcccagcccattgacagtg

SEQ ID NO: 10056771 - DNA, 22 bp, Homo sapiens
cagcccaggactgcaggtgttt

SEQ ID NO: 10056772 - DNA, 22 bp, Homo sapiens
cagcccaggccgacagttcctc

SEQ ID NO: 10056773 - DNA, 22 bp, Homo sapiens
cagctctgtgcaggcctgggga

SEQ ID NO: 10056774 - DNA, 19 bp, Homo sapiens
gtggccagggcaggggctg

SEQ ID NO: 10056775 - DNA, 22 bp, Homo sapiens
gtggcagtgaggcaggagcagt

SEQ ID NO: 10056776 - DNA, 22 bp, Homo sapiens
gtggccaggcgtccgcgcggct

SEQ ID NO: 10056777 - DNA, 22 bp, Homo sapiens
gtggcagtctcatctgtggctc

SEQ ID NO: 10056778 - DNA, 22 bp, Homo sapiens
gtggcagtagacagtgcatcta

SEQ ID NO: 10056779 - DNA, 22 bp, Homo sapiens
gtggcaggttccgtagacagca

SEQ ID NO: 10056780 - DNA, 22 bp, Homo sapiens
cagctcttattttctctcctaa

SEQ ID NO: 10056781 - DNA, 22 bp, Homo sapiens
cagctcttccctcttcttgtag

SEQ ID NO: 10056782 - DNA, 22 bp, Homo sapiens
cagctcttcctaccctagttgg

SEQ ID NO: 10056783 - DNA, 22 bp, Homo sapiens
cagctctttttcacacaacatg

SEQ ID NO: 10056784 - DNA, 18 bp, Homo sapiens
cagctcttctccagtaac

SEQ ID NO: 10056785 - DNA, 22 bp, Homo sapiens
cagctcttcctagccatgccac

SEQ ID NO: 10056786 - DNA, 22 bp, Homo sapiens
gtggctatatttgaggatacgt

SEQ ID NO: 10056787 - DNA, 22 bp, Homo sapiens
gtgggcagtgcctgacggatga

SEQ ID NO: 10056788 - DNA, 22 bp, Homo sapiens
gtggggagggagatgctgaagt

SEQ ID NO: 10056789 - DNA, 22 bp, Homo sapiens
gtgggcaggccctaggcgattt

SEQ ID NO: 10056790 - DNA, 22 bp, Homo sapiens
taacaagatttgtaaaattgta

SEQ ID NO: 10056791 - DNA, 22 bp, Homo sapiens
taacagaaatagtaggtgaggg

SEQ ID NO: 10056792 - DNA, 22 bp, Homo sapiens
taacagaaaggggacagaaata

SEQ ID NO: 10056793 - DNA, 22 bp, Homo sapiens
taacagaaatatttccaggtga

SEQ ID NO: 10056794 - DNA, 22 bp, Homo sapiens
caggcacagtgttgctgttcaa

SEQ ID NO: 10056795 - DNA, 22 bp, Homo sapiens
caggcacagtgttgctgttcaa

SEQ ID NO: 10056796 - DNA, 22 bp, Homo sapiens
caggcacagtgttgctgttcaa

SEQ ID NO: 10056797 - DNA, 22 bp, Homo sapiens
caggcacagtggggtcctctct

SEQ ID NO: 10056798 - DNA, 22 bp, Homo sapiens
caggcacatgggagctcatcat

SEQ ID NO: 10056799 - DNA, 22 bp, Homo sapiens
taagacacagtccgcactctct

SEQ ID NO: 10056800 - DNA, 22 bp, Homo sapiens
taagacacagtccgcactctct

SEQ ID NO: 10056801 - DNA, 22 bp, Homo sapiens
taagacacaaatatcttttaca

SEQ ID NO: 10056802 - DNA, 19 bp, Homo sapiens
taagacacaaatgcaagcc

SEQ ID NO: 10056803 - DNA, 22 bp, Homo sapiens
caggcacatgggagctcatcat

SEQ ID NO: 10056804 - DNA, 22 bp, Homo sapiens
caggcacaagatcggctagata

SEQ ID NO: 10056805 - DNA, 22 bp, Homo sapiens
caggatggtggcatgatcagaa

SEQ ID NO: 10056806 - DNA, 22 bp, Homo sapiens
taagcaaaggattttgatcttt

SEQ ID NO: 10056807 - DNA, 22 bp, Homo sapiens
taagacacattggagtagatga

SEQ ID NO: 10056808 - DNA, 22 bp, Homo sapiens
taagacacattggagtagatga

SEQ ID NO: 10056809 - DNA, 22 bp, Homo sapiens
taagacacattgagaaacacaa

SEQ ID NO: 10056810 - DNA, 22 bp, Homo sapiens
taagacacattgagaaacacaa

SEQ ID NO: 10056811 - DNA, 22 bp, Homo sapiens
taagacacattcatatctgtct

SEQ ID NO: 10056812 - DNA, 22 bp, Homo sapiens
taagacacattcatatctgtct

SEQ ID NO: 10056813 - DNA, 22 bp, Homo sapiens
taagacacatgcgtacaagata

SEQ ID NO: 10056814 - DNA, 22 bp, Homo sapiens
taagacacatgcgtacaagata

SEQ ID NO: 10056815 - DNA, 22 bp, Homo sapiens
taagacacgggctgatctaaag

SEQ ID NO: 10056816 - DNA, 22 bp, Homo sapiens
taagacacctctctgcccttca

SEQ ID NO: 10056817 - DNA, 22 bp, Homo sapiens
taagacacctctctgcccttca

SEQ ID NO: 10056818 - DNA, 23 bp, Homo sapiens
taagacacccgactccagagatg

SEQ ID NO: 10056819 - DNA, 22 bp, Homo sapiens
taagacacattggagtagatga

SEQ ID NO: 10056820 - DNA, 23 bp, Homo sapiens
taagacacccgactccagagatg

SEQ ID NO: 10056821 - DNA, 22 bp, Homo sapiens
taagacacgggctgatctaaag

SEQ ID NO: 10056822 - DNA, 22 bp, Homo sapiens
tacaatacttaacctattttgc

SEQ ID NO: 10056823 - DNA, 22 bp, Homo sapiens
tacagggtataggtacagatga

SEQ ID NO: 10056824 - DNA, 20 bp, Homo sapiens
tacaagtacattatagttat

SEQ ID NO: 10056825 - DNA, 22 bp, Homo sapiens
tacaagtgctagcagatattgt

SEQ ID NO: 10056826 - DNA, 22 bp, Homo sapiens
tacatattcaacgttcagtatt

SEQ ID NO: 10056827 - DNA, 22 bp, Homo sapiens
tacagtttgttacattgttagt

SEQ ID NO: 10056828 - DNA, 22 bp, Homo sapiens
tacagtaaccagtctacttaga

SEQ ID NO: 10056829 - DNA, 22 bp, Homo sapiens
caggcagagacgtcagtgtagg

SEQ ID NO: 10056830 - DNA, 22 bp, Homo sapiens
caggcagccaggggacctgtcc

SEQ ID NO: 10056831 - DNA, 22 bp, Homo sapiens
taaatgcttagattcatagaaa

SEQ ID NO: 10056832 - DNA, 22 bp, Homo sapiens
taaatcaagaatatcagcttgt

SEQ ID NO: 10056833 - DNA, 22 bp, Homo sapiens
taaatatcacctggaattgtta

SEQ ID NO: 10056834 - DNA, 22 bp, Homo sapiens
taaagccaatatacctagcata

SEQ ID NO: 10056835 - DNA, 22 bp, Homo sapiens
taaagtcataagagtggatccg

SEQ ID NO: 10056836 - DNA, 22 bp, Homo sapiens
taaagtcagatatctgggttga

SEQ ID NO: 10056837 - DNA, 23 bp, Homo sapiens
taaagtcacatattagagtgagc

SEQ ID NO: 10056838 - DNA, 22 bp, Homo sapiens
taaagtcatctttacatctttg

SEQ ID NO: 10056839 - DNA, 22 bp, Homo sapiens
taaagtcatctttaaacatgcc

SEQ ID NO: 10056840 - DNA, 22 bp, Homo sapiens
caggagctactcaggttgggtt

SEQ ID NO: 10056841 - DNA, 22 bp, Homo sapiens
taaagcagtgtggttgtgtccc

SEQ ID NO: 10056842 - DNA, 22 bp, Homo sapiens
caggagcaaatccaaaagaatt

SEQ ID NO: 10056843 - DNA, 22 bp, Homo sapiens
caggagtgtttgctacagtttc

SEQ ID NO: 10056844 - DNA, 22 bp, Homo sapiens
caggagtgttgattgctcagga

SEQ ID NO: 10056845 - DNA, 22 bp, Homo sapiens
caggagtgtcgggtcactaggt

SEQ ID NO: 10056846 - DNA, 22 bp, Homo sapiens
caggagtgtctccacacagcaa

SEQ ID NO: 10056847 - DNA, 20 bp, Homo sapiens
caggagggacatttcagcat

SEQ ID NO: 10056848 - DNA, 22 bp, Homo sapiens
taaatgtctgttaacatgaatg

SEQ ID NO: 10056849 - DNA, 22 bp, Homo sapiens
taaatgtcaatgtgatttataa

SEQ ID NO: 10056850 - DNA, 22 bp, Homo sapiens
taaatgtgaccttcattttata

SEQ ID NO: 10056851 - DNA, 22 bp, Homo sapiens
taaatgtctgttaacatgaatg

SEQ ID NO: 10056852 - DNA, 22 bp, Homo sapiens
caggaggcagaggttgcagcga

SEQ ID NO: 10056853 - DNA, 22 bp, Homo sapiens
taaactgaagctcaactcaaat

SEQ ID NO: 10056854 - DNA, 22 bp, Homo sapiens
taaactcttctgtagaatcaga

SEQ ID NO: 10056855 - DNA, 22 bp, Homo sapiens
caggagaaggtttggagtgcag

SEQ ID NO: 10056856 - DNA, 22 bp, Homo sapiens
caggagaagtctctagggggtg

SEQ ID NO: 10056857 - DNA, 22 bp, Homo sapiens
caggagacaatggctgtggggc

SEQ ID NO: 10056858 - DNA, 22 bp, Homo sapiens
taaaatgacttcctccaacatc

SEQ ID NO: 10056859 - DNA, 22 bp, Homo sapiens
taaaaaacattactctgtcctg

SEQ ID NO: 10056860 - DNA, 22 bp, Homo sapiens
taaaaaacattactctgtcctg

SEQ ID NO: 10056861 - DNA, 22 bp, Homo sapiens
taaaaaacattactctgtcctg

SEQ ID NO: 10056862 - DNA, 22 bp, Homo sapiens
gttttctcaggatggtgtgtac

SEQ ID NO: 10056863 - DNA, 22 bp, Homo sapiens
caggacacatttcttgttcagg

SEQ ID NO: 10056864 - DNA, 22 bp, Homo sapiens
caggacaattttgagccacctg

SEQ ID NO: 10056865 - DNA, 22 bp, Homo sapiens
caggacaagagggaatcgataa

SEQ ID NO: 10056866 - DNA, 22 bp, Homo sapiens
caggacactaaaaagccaagct

SEQ ID NO: 10056867 - DNA, 22 bp, Homo sapiens
caggaagccacaggacaggtag

SEQ ID NO: 10056868 - DNA, 22 bp, Homo sapiens
catgcaaatgtgctaatctgaa

SEQ ID NO: 10056869 - DNA, 22 bp, Homo sapiens
catgcaaacacgtaaacattca

SEQ ID NO: 10056870 - DNA, 22 bp, Homo sapiens
catgtcttatatcctgtcttca

SEQ ID NO: 10056871 - DNA, 22 bp, Homo sapiens
tccagcccagctcctctcagaa

SEQ ID NO: 10056872 - DNA, 20 bp, Homo sapiens
tccagcccagcagcctgaca

SEQ ID NO: 10056873 - DNA, 22 bp, Homo sapiens
catgtctttgttatgctcacca

SEQ ID NO: 10056874 - DNA, 22 bp, Homo sapiens
catgtcttgccctgattagtag

SEQ ID NO: 10056875 - DNA, 22 bp, Homo sapiens
tccaggcaagggaggagcatgg

SEQ ID NO: 10056876 - DNA, 22 bp, Homo sapiens
catccccagagcagttccacta

SEQ ID NO: 10056877 - DNA, 22 bp, Homo sapiens
tcagtttaagatgactaacaat

SEQ ID NO: 10056878 - DNA, 22 bp, Homo sapiens
tcatgtaaagtgtaggtttaga

SEQ ID NO: 10056879 - DNA, 22 bp, Homo sapiens
tcagtttagagttatttaatct

SEQ ID NO: 10056880 - DNA, 22 bp, Homo sapiens
tcagtttcacagtctgtgcaga

SEQ ID NO: 10056881 - DNA, 22 bp, Homo sapiens
catatcatttgcttataaatct

SEQ ID NO: 10056882 - DNA, 22 bp, Homo sapiens
catagacaaagatcagaagagt

SEQ ID NO: 10056883 - DNA, 22 bp, Homo sapiens
catccagaccgtgccatgctgc

SEQ ID NO: 10056884 - DNA, 22 bp, Homo sapiens
catccagagtccaaggctgggc

SEQ ID NO: 10056885 - DNA, 22 bp, Homo sapiens
catccagaccgtgccatgctgc

SEQ ID NO: 10056886 - DNA, 22 bp, Homo sapiens
catccaggctggagtacagtgg

SEQ ID NO: 10056887 - DNA, 22 bp, Homo sapiens
catccaggctgaagtgcagtgg

SEQ ID NO: 10056888 - DNA, 22 bp, Homo sapiens
catcacatgtaggcagcatcac

SEQ ID NO: 10056889 - DNA, 22 bp, Homo sapiens
tcagggattgcaaaattcatcc

SEQ ID NO: 10056890 - DNA, 22 bp, Homo sapiens
tcagcccagggacagaggcccc

SEQ ID NO: 10056891 - DNA, 20 bp, Homo sapiens
tcagcccagggtgagcatct

SEQ ID NO: 10056892 - DNA, 22 bp, Homo sapiens
tcagaaggtggaggttgcagtg

SEQ ID NO: 10056893 - DNA, 22 bp, Homo sapiens
tcagccctgggacccagggatg

SEQ ID NO: 10056894 - DNA, 22 bp, Homo sapiens
tcagccctgaggacagaggcag

SEQ ID NO: 10056895 - DNA, 22 bp, Homo sapiens
tcagccccacggggtcagccaa

SEQ ID NO: 10056896 - DNA, 18 bp, Homo sapiens
cagtgctgttaacagtga

SEQ ID NO: 10056897 - DNA, 22 bp, Homo sapiens
cagtgctgtgtttgctgcctgg

SEQ ID NO: 10056898 - DNA, 22 bp, Homo sapiens
cagtgctgttgggcccagagag

SEQ ID NO: 10056899 - DNA, 22 bp, Homo sapiens
cagtgctgtgctggaagctgtt

SEQ ID NO: 10056900 - DNA, 22 bp, Homo sapiens
tcaccaggctcctgttaagatg

SEQ ID NO: 10056901 - DNA, 22 bp, Homo sapiens
tcaccaggctagagtgcagtgg

SEQ ID NO: 10056902 - DNA, 22 bp, Homo sapiens
tcaccaggctggagtgcagtgg

SEQ ID NO: 10056903 - DNA, 22 bp, Homo sapiens
tcactcaggctggagtgcagtg

SEQ ID NO: 10056904 - DNA, 22 bp, Homo sapiens
tcacccaagaccatcggaagtg

SEQ ID NO: 10056905 - DNA, 22 bp, Homo sapiens
tattggaagtgaacaccaggct

SEQ ID NO: 10056906 - DNA, 22 bp, Homo sapiens
tatttagaatgcgtgtacgtgt

SEQ ID NO: 10056907 - DNA, 22 bp, Homo sapiens
tatttagaacagacaatagaaa

SEQ ID NO: 10056908 - DNA, 22 bp, Homo sapiens
tatttacttttaaattgagaac

SEQ ID NO: 10056909 - DNA, 20 bp, Homo sapiens
tatttacaacttagagcctc

SEQ ID NO: 10056910 - DNA, 22 bp, Homo sapiens
tatttagttatctttcataaaa

SEQ ID NO: 10056911 - DNA, 22 bp, Homo sapiens
tatttagtgatagaagcaagga

SEQ ID NO: 10056912 - DNA, 22 bp, Homo sapiens
cagtcctgggtgcagcaggaaa

SEQ ID NO: 10056913 - DNA, 22 bp, Homo sapiens
cagtccttaaggaaacatttgt

SEQ ID NO: 10056914 - DNA, 22 bp, Homo sapiens
cagtccttaaggaaacatttgt

SEQ ID NO: 10056915 - DNA, 22 bp, Homo sapiens
cagtccttgctctgggatgatg

SEQ ID NO: 10056916 - DNA, 22 bp, Homo sapiens
cagtccttggcaagttctcagt

SEQ ID NO: 10056917 - DNA, 22 bp, Homo sapiens
cagtccttggcaagttctcagt

SEQ ID NO: 10056918 - DNA, 22 bp, Homo sapiens
cagtccttgctatgaccctgag

SEQ ID NO: 10056919 - DNA, 22 bp, Homo sapiens
cagtccttgctcaaagtctaca

SEQ ID NO: 10056920 - DNA, 22 bp, Homo sapiens
cagtccttgatccaatagtggg

SEQ ID NO: 10056921 - DNA, 22 bp, Homo sapiens
cagtccttagattttactgcca

SEQ ID NO: 10056922 - DNA, 22 bp, Homo sapiens
cagtccttagtctggatggctt

SEQ ID NO: 10056923 - DNA, 22 bp, Homo sapiens
cagtccttattcctatattcct

SEQ ID NO: 10056924 - DNA, 22 bp, Homo sapiens
cagtccttattcctatattcct

SEQ ID NO: 10056925 - DNA, 22 bp, Homo sapiens
cagtccttcattcctcctttga

SEQ ID NO: 10056926 - DNA, 22 bp, Homo sapiens
cagtccttccttgccccttggg

SEQ ID NO: 10056927 - DNA, 22 bp, Homo sapiens
cagtccttctccattaaggctc

SEQ ID NO: 10056928 - DNA, 22 bp, Homo sapiens
cagtcctttctgaaatcctata

SEQ ID NO: 10056929 - DNA, 17 bp, Homo sapiens
cagtcgaggaggacctg

SEQ ID NO: 10056930 - DNA, 22 bp, Homo sapiens
cagtcctttcaatggtgacctt

SEQ ID NO: 10056931 - DNA, 22 bp, Homo sapiens
cagtccttggcttcatccgagt

SEQ ID NO: 10056932 - DNA, 19 bp, Homo sapiens
cagtcctttccgctttctc

SEQ ID NO: 10056933 - DNA, 18 bp, Homo sapiens
caggtctgtctgcctccc

SEQ ID NO: 10056934 - DNA, 22 bp, Homo sapiens
caggtctggtgagagaacagtt

SEQ ID NO: 10056935 - DNA, 22 bp, Homo sapiens
tattaaatatatctgttagttg

SEQ ID NO: 10056936 - DNA, 22 bp, Homo sapiens
tattaaagagagaatcatcatc

SEQ ID NO: 10056937 - DNA, 22 bp, Homo sapiens
tatgtttttcaagtgcacacta

SEQ ID NO: 10056938 - DNA, 22 bp, Homo sapiens
tataatctggttttattaagag

SEQ ID NO: 10056939 - DNA, 22 bp, Homo sapiens
tataagaaattgccaacctgtt

SEQ ID NO: 10056940 - DNA, 22 bp, Homo sapiens
caggtctgaagagtcacatgcc

SEQ ID NO: 10056941 - DNA, 22 bp, Homo sapiens
caggtctgcagacagggccatg

SEQ ID NO: 10056942 - DNA, 22 bp, Homo sapiens
tctgcctgaaattcacatgtaa

SEQ ID NO: 10056943 - DNA, 22 bp, Homo sapiens
ccagctgggattaagggaaaat

SEQ ID NO: 10056944 - DNA, 22 bp, Homo sapiens
ccagctgctttttgtcacatgg

SEQ ID NO: 10056945 - DNA, 22 bp, Homo sapiens
ccagctggtgttccttaggacc

SEQ ID NO: 10056946 - DNA, 22 bp, Homo sapiens
tctggagctggagggcaaggca

SEQ ID NO: 10056947 - DNA, 22 bp, Homo sapiens
tctggagctggcagggccctgg

SEQ ID NO: 10056948 - DNA, 18 bp, Homo sapiens
ccagctgtgcagcatctg

SEQ ID NO: 10056949 - DNA, 22 bp, Homo sapiens
ccagctgtgccggggacctggg

SEQ ID NO: 10056950 - DNA, 22 bp, Homo sapiens
ccagctgtcttgagaggaggca

SEQ ID NO: 10056951 - DNA, 22 bp, Homo sapiens
ccagctgtctggttccagagcc

SEQ ID NO: 10056952 - DNA, 22 bp, Homo sapiens
ccagctgtttctgatgctaggc

SEQ ID NO: 10056953 - DNA, 22 bp, Homo sapiens
ccagctgtgcctaggagcaggg

SEQ ID NO: 10056954 - DNA, 22 bp, Homo sapiens
ccagctgtgctgttggcttgtc

SEQ ID NO: 10056955 - DNA, 21 bp, Homo sapiens
tctgtcttcctcagcctaagg

SEQ ID NO: 10056956 - DNA, 22 bp, Homo sapiens
tctgtcttggccagccatctgg

SEQ ID NO: 10056957 - DNA, 22 bp, Homo sapiens
tctgtcttagccatctcaggct

SEQ ID NO: 10056958 - DNA, 22 bp, Homo sapiens
tctgtcacccctgtttctggct

SEQ ID NO: 10056959 - DNA, 23 bp, Homo sapiens
tctgtcactttctgctgtggagt

SEQ ID NO: 10056960 - DNA, 22 bp, Homo sapiens
ccaggaagacacatgctcatcc

SEQ ID NO: 10056961 - DNA, 22 bp, Homo sapiens
tctcttaataagtaaatactga

SEQ ID NO: 10056962 - DNA, 22 bp, Homo sapiens
tctctcttgaagtattagctag

SEQ ID NO: 10056963 - DNA, 22 bp, Homo sapiens
tctcttaactggttcagcaatt

SEQ ID NO: 10056964 - DNA, 22 bp, Homo sapiens
tctcttgggaggaaagagagaa

SEQ ID NO: 10056965 - DNA, 22 bp, Homo sapiens
ccagccagtcccgcatgaccgc

SEQ ID NO: 10056966 - DNA, 22 bp, Homo sapiens
ccagccagtcccgcatgaccgc

SEQ ID NO: 10056967 - DNA, 22 bp, Homo sapiens
ccagcccctatcctcgctccac

SEQ ID NO: 10056968 - DNA, 22 bp, Homo sapiens
ccagcccctatcctcgctccac

SEQ ID NO: 10056969 - DNA, 22 bp, Homo sapiens
ccagccccgggccttaccgtgc

SEQ ID NO: 10056970 - DNA, 22 bp, Homo sapiens
ccagccccgggaacctggccgt

SEQ ID NO: 10056971 - DNA, 22 bp, Homo sapiens
ccagccccgggaacctggccgt

SEQ ID NO: 10056972 - DNA, 22 bp, Homo sapiens
ccagctctcaaggctccctggg

SEQ ID NO: 10056973 - DNA, 22 bp, Homo sapiens
ccagctctaaacggctctgtgg

SEQ ID NO: 10056974 - DNA, 22 bp, Homo sapiens
ccagctcctcttgtctctagca

SEQ ID NO: 10056975 - DNA, 20 bp, Homo sapiens
ccacagaggacagggctgtg

SEQ ID NO: 10056976 - DNA, 20 bp, Homo sapiens
ccacagaggacagggctgtg

SEQ ID NO: 10056977 - DNA, 22 bp, Homo sapiens
ccacagaggacaactgcctggc

SEQ ID NO: 10056978 - DNA, 22 bp, Homo sapiens
ccacagaggacaactgcctggc

SEQ ID NO: 10056979 - DNA, 22 bp, Homo sapiens
ccacagcaccgctgccagtccc

SEQ ID NO: 10056980 - DNA, 22 bp, Homo sapiens
ccacagcacctgcagccagttg

SEQ ID NO: 10056981 - DNA, 18 bp, Homo sapiens
ccacagcagagttcttac

SEQ ID NO: 10056982 - DNA, 23 bp, Homo sapiens
ccacagctatagggtagtgcagt

SEQ ID NO: 10056983 - DNA, 22 bp, Homo sapiens
tcctcccacataggacaatggg

SEQ ID NO: 10056984 - DNA, 23 bp, Homo sapiens
tcctcccaaatttcagcctcatt

SEQ ID NO: 10056985 - DNA, 22 bp, Homo sapiens
ccaaagtgctggggttacaggc

SEQ ID NO: 10056986 - DNA, 21 bp, Homo sapiens
ccacaattctagttacatatg

SEQ ID NO: 10056987 - DNA, 22 bp, Homo sapiens
ccacaaaactgtgtgtcaaaga

SEQ ID NO: 10056988 - DNA, 19 bp, Homo sapiens
ccacaaaattattttagtt

SEQ ID NO: 10056989 - DNA, 19 bp, Homo sapiens
ccaaaagcaattccaagta

SEQ ID NO: 10056990 - DNA, 22 bp, Homo sapiens
catttgcatatgaagaagtaag

SEQ ID NO: 10056991 - DNA, 22 bp, Homo sapiens
catttgcaagagataaatgttt

SEQ ID NO: 10056992 - DNA, 22 bp, Homo sapiens
catttgcagagggtgacactct

SEQ ID NO: 10056993 - DNA, 22 bp, Homo sapiens
catttgcaaaccaacaagatga

SEQ ID NO: 10056994 - DNA, 22 bp, Homo sapiens
catttatataaaatgtccagaa

SEQ ID NO: 10056995 - DNA, 22 bp, Homo sapiens
catttatataaaatgtccagaa

SEQ ID NO: 10056996 - DNA, 21 bp, Homo sapiens
catttctattgatgagaaaag

SEQ ID NO: 10056997 - DNA, 22 bp, Homo sapiens
catttagagaagattacaagga

SEQ ID NO: 10056998 - DNA, 22 bp, Homo sapiens
catttacacttctaaccacaag

SEQ ID NO: 10056999 - DNA, 20 bp, Homo sapiens
tcctggtggatactgcttaa

SEQ ID NO: 10057000 - DNA, 22 bp, Homo sapiens
ccactgagaaggggttggggtc

SEQ ID NO: 10057001 - DNA, 22 bp, Homo sapiens
ccacagtctagctagaaggcat

SEQ ID NO: 10057002 - DNA, 22 bp, Homo sapiens
ccacagtctatgcaacaaggtc

SEQ ID NO: 10057003 - DNA, 22 bp, Homo sapiens
ccacagtccgggctggcaggac

SEQ ID NO: 10057004 - DNA, 22 bp, Homo sapiens
ccacagtcctggcttctgtctg

SEQ ID NO: 10057005 - DNA, 20 bp, Homo sapiens
ccagaaggtttgccactttc

SEQ ID NO: 10057006 - DNA, 19 bp, Homo sapiens
ccagaagggcagctatgga

SEQ ID NO: 10057007 - DNA, 22 bp, Homo sapiens
ccagaagggctattgcagtgac

SEQ ID NO: 10057008 - DNA, 22 bp, Homo sapiens
ccagaatagaaggcagctgtca

SEQ ID NO: 10057009 - DNA, 22 bp, Homo sapiens
ccagaagagatcacagttcttg

SEQ ID NO: 10057010 - DNA, 22 bp, Homo sapiens
ccagaagaggacacagtgtgga

SEQ ID NO: 10057011 - DNA, 22 bp, Homo sapiens
ccagaaggcggagattgcagtg

SEQ ID NO: 10057012 - DNA, 22 bp, Homo sapiens
ccactgagtgagcagagcaggg

SEQ ID NO: 10057013 - DNA, 22 bp, Homo sapiens
ccactgagtacccgatggctgc

SEQ ID NO: 10057014 - DNA, 22 bp, Homo sapiens
ccactgaggcctgggcccaggg

SEQ ID NO: 10057015 - DNA, 22 bp, Homo sapiens
ccactgaggttttgtggttatg

SEQ ID NO: 10057016 - DNA, 22 bp, Homo sapiens
ccactgaggggtcatggtggga

SEQ ID NO: 10057017 - DNA, 22 bp, Homo sapiens
ccactgagcagtagctgcgtcg

SEQ ID NO: 10057018 - DNA, 22 bp, Homo sapiens
tctcccaagggcacattcaagg

SEQ ID NO: 10057019 - DNA, 22 bp, Homo sapiens
tctctaaatgattgtgtactcc

SEQ ID NO: 10057020 - DNA, 20 bp, Homo sapiens
ccagacagcacctgcctggt

SEQ ID NO: 10057021 - DNA, 20 bp, Homo sapiens
ccagacagcacctgcctggt

SEQ ID NO: 10057022 - DNA, 22 bp, Homo sapiens
ccagagctgatgggcccagggt

SEQ ID NO: 10057023 - DNA, 22 bp, Homo sapiens
ccagacaggaacacacatctcc

SEQ ID NO: 10057024 - DNA, 18 bp, Homo sapiens
ccagagctggctcctcgc

SEQ ID NO: 10057025 - DNA, 19 bp, Homo sapiens
tctctacactacatttcta

SEQ ID NO: 10057026 - DNA, 22 bp, Homo sapiens
tctttattgctactggtttgtc

SEQ ID NO: 10057027 - DNA, 22 bp, Homo sapiens
tctttattgctactggtttgtc

SEQ ID NO: 10057028 - DNA, 22 bp, Homo sapiens
tctttataaaagtcattatgtc

SEQ ID NO: 10057029 - DNA, 22 bp, Homo sapiens
tctttatcaagtctgttctttg

SEQ ID NO: 10057030 - DNA, 22 bp, Homo sapiens
tctttatgtttgaaagtacaat

SEQ ID NO: 10057031 - DNA, 22 bp, Homo sapiens
tctttagtgacagttgtgcaag

SEQ ID NO: 10057032 - DNA, 22 bp, Homo sapiens
tctttagaaacttttcttcatg

SEQ ID NO: 10057033 - DNA, 22 bp, Homo sapiens
tctttagagctcagaaatacag

SEQ ID NO: 10057034 - DNA, 22 bp, Homo sapiens
tctttcggccatagcgatgatt

SEQ ID NO: 10057035 - DNA, 22 bp, Homo sapiens
tctttgatcagcctttcactga

SEQ ID NO: 10057036 - DNA, 22 bp, Homo sapiens
tctttgatgtggttaattatga

SEQ ID NO: 10057037 - DNA, 22 bp, Homo sapiens
tcttgcttgatacatggaggaa

SEQ ID NO: 10057038 - DNA, 22 bp, Homo sapiens
tctttacttgtgtattgtatat

SEQ ID NO: 10057039 - DNA, 23 bp, Homo sapiens
tctttacatactgatgagttctc

SEQ ID NO: 10057040 - DNA, 22 bp, Homo sapiens
tctttacaatctaagcatagtt

SEQ ID NO: 10057041 - DNA, 22 bp, Homo sapiens
tctttaatgtgattgtaattat

SEQ ID NO: 10057042 - DNA, 22 bp, Homo sapiens
tctttaatcataaccaagatgg

SEQ ID NO: 10057043 - DNA, 22 bp, Homo sapiens
tcttgggaggagcacctgcctg

SEQ ID NO: 10057044 - DNA, 22 bp, Homo sapiens
tcttgggattgccctgcagttc

SEQ ID NO: 10057045 - DNA, 22 bp, Homo sapiens
tcttccaaaattagtctcagtt

SEQ ID NO: 10057046 - DNA, 22 bp, Homo sapiens
tcttccaaatgaatatggtttt

SEQ ID NO: 10057047 - DNA, 22 bp, Homo sapiens
tcttccaaatgcagctaaagct

SEQ ID NO: 10057048 - DNA, 21 bp, Homo sapiens
tcttccaagggctgctgagac

SEQ ID NO: 10057049 - DNA, 18 bp, Homo sapiens
tcttccaacactgacacc

SEQ ID NO: 10057050 - DNA, 22 bp, Homo sapiens
tcttccaaggtgcagatcttct

SEQ ID NO: 10057051 - DNA, 22 bp, Homo sapiens
tcttccaaggttgcacactatc

SEQ ID NO: 10057052 - DNA, 22 bp, Homo sapiens
tcttccaatacctagattttgg

SEQ ID NO: 10057053 - DNA, 22 bp, Homo sapiens
tcttccaatggtttctagattt

SEQ ID NO: 10057054 - DNA, 22 bp, Homo sapiens
tcttccaattagaatatttggg

SEQ ID NO: 10057055 - DNA, 22 bp, Homo sapiens
tcttcagtaggtcctcagaatc

SEQ ID NO: 10057056 - DNA, 22 bp, Homo sapiens
tcttcagcaactccccaatctg

SEQ ID NO: 10057057 - DNA, 22 bp, Homo sapiens
tcttcaatttagaatggattta

SEQ ID NO: 10057058 - DNA, 22 bp, Homo sapiens
tcttattttagagccccgagcc

SEQ ID NO: 10057059 - DNA, 22 bp, Homo sapiens
tcttcctgaaaccctgttccag

SEQ ID NO: 10057060 - DNA, 22 bp, Homo sapiens
tcttctctacaccagcagcccc

SEQ ID NO: 10057061 - DNA, 22 bp, Homo sapiens
tcttcttcctcatttatacata

SEQ ID NO: 10057062 - DNA, 22 bp, Homo sapiens
tcttctttggatgaaagaatat

SEQ ID NO: 10057063 - DNA, 22 bp, Homo sapiens
tctgtgagtactttaacgagag

SEQ ID NO: 10057064 - DNA, 22 bp, Homo sapiens
tctgtgctgtctcagagaaagc

SEQ ID NO: 10057065 - DNA, 22 bp, Homo sapiens
tctgtttatgcatatttaaaac

SEQ ID NO: 10057066 - DNA, 22 bp, Homo sapiens
tctgttgcaatgtgcatggtga

SEQ ID NO: 10057067 - DNA, 22 bp, Homo sapiens
tctgttatatgttttttctaaa

SEQ ID NO: 10057068 - DNA, 18 bp, Homo sapiens
tctgtgttctgtcattgc

SEQ ID NO: 10057069 - DNA, 22 bp, Homo sapiens
tctgtgtttaaaagatatgtcc

SEQ ID NO: 10057070 - DNA, 22 bp, Homo sapiens
tctgtgttttaaacagtagaaa

SEQ ID NO: 10057071 - DNA, 22 bp, Homo sapiens
tctgtgtgggatagtttgagga

SEQ ID NO: 10057072 - DNA, 22 bp, Homo sapiens
tctgtgtgggatagtttgagga

SEQ ID NO: 10057073 - DNA, 22 bp, Homo sapiens
tctgtgtgttgtcaggaggatt

SEQ ID NO: 10057074 - DNA, 22 bp, Homo sapiens
tctgtgtgaccataagccagct

SEQ ID NO: 10057075 - DNA, 22 bp, Homo sapiens
tcttaaactttgctgtaattct

SEQ ID NO: 10057076 - DNA, 22 bp, Homo sapiens
tcttaaaccacaaaattcagag

SEQ ID NO: 10057077 - DNA, 22 bp, Homo sapiens
tctgggcttggattggctctgc

SEQ ID NO: 10057078 - DNA, 22 bp, Homo sapiens
tctgggctttacactgtgctta

SEQ ID NO: 10057079 - DNA, 22 bp, Homo sapiens
tctgggggcgaccagggactgc

SEQ ID NO: 10057080 - DNA, 22 bp, Homo sapiens
tctgggggaggaggcatggccc

SEQ ID NO: 10057081 - DNA, 22 bp, Homo sapiens
tctgggggttaagtgaggacaa

SEQ ID NO: 10057082 - DNA, 22 bp, Homo sapiens
tctgggtggcagtgatggcgtg

SEQ ID NO: 10057083 - DNA, 22 bp, Homo sapiens
tctgtcctgtttcctcctgaca

SEQ ID NO: 10057084 - DNA, 22 bp, Homo sapiens
tctgtccattcagccatccatc

SEQ ID NO: 10057085 - DNA, 22 bp, Homo sapiens
tctgtccattttccattttggc

SEQ ID NO: 10057086 - DNA, 22 bp, Homo sapiens
tctgtacaccaggggccattct

SEQ ID NO: 10057087 - DNA, 20 bp, Homo sapiens
tctgtacactcatcttctgc

SEQ ID NO: 10057088 - DNA, 22 bp, Homo sapiens
tctgtacatgagttgagaatca

SEQ ID NO: 10057089 - DNA, 22 bp, Homo sapiens
tctgtacaacaaagggatgaga

SEQ ID NO: 10057090 - DNA, 22 bp, Homo sapiens
tctgtaaagactccaaaagcca

SEQ ID NO: 10057091 - DNA, 22 bp, Homo sapiens
tctgagagagggtcagatgcta

SEQ ID NO: 10057092 - DNA, 22 bp, Homo sapiens
tctgagacaggaagtggagggt

SEQ ID NO: 10057093 - DNA, 23 bp, Homo sapiens
tctgagagaacaatgcctcctat

SEQ ID NO: 10057094 - DNA, 22 bp, Homo sapiens
tctgacatgagggctgtggaga

SEQ ID NO: 10057095 - DNA, 22 bp, Homo sapiens
tctgaattttgaaatcatggag

SEQ ID NO: 10057096 - DNA, 22 bp, Homo sapiens
tctgacagctccaggcagcaat

SEQ ID NO: 10057097 - DNA, 22 bp, Homo sapiens
tctgcaacattcctctccccac

SEQ ID NO: 10057098 - DNA, 22 bp, Homo sapiens
tctgagggtgggagaaggagct

SEQ ID NO: 10057099 - DNA, 22 bp, Homo sapiens
tctgagggcttgaggggaagta

SEQ ID NO: 10057100 - DNA, 22 bp, Homo sapiens
tctgcatctgtgttgagtgccc

SEQ ID NO: 10057101 - DNA, 19 bp, Homo sapiens
tctgcatggcaggaagaga

SEQ ID NO: 10057102 - DNA, 22 bp, Homo sapiens
tctgcaggtaagcgttcttgga

SEQ ID NO: 10057103 - DNA, 22 bp, Homo sapiens
tctgcccaaggctgtcactaga

SEQ ID NO: 10057104 - DNA, 22 bp, Homo sapiens
tctgccacatgagggcacagca

SEQ ID NO: 10057105 - DNA, 22 bp, Homo sapiens
tctgcagaaagtggctcagtgg

SEQ ID NO: 10057106 - DNA, 18 bp, Homo sapiens
tctgcactcctgagagag

SEQ ID NO: 10057107 - DNA, 22 bp, Homo sapiens
tctgcagaaactgtgactatgt

SEQ ID NO: 10057108 - DNA, 22 bp, Homo sapiens
tctgcaggaggctggctgcagg

SEQ ID NO: 10057109 - DNA, 22 bp, Homo sapiens
tctgcccctgctgggcacagag

SEQ ID NO: 10057110 - DNA, 22 bp, Homo sapiens
tctgcccactgctctgctgccc

SEQ ID NO: 10057111 - DNA, 22 bp, Homo sapiens
tctgcccactgctctgctgccc

SEQ ID NO: 10057112 - DNA, 22 bp, Homo sapiens
tctgcctgagggagctgaggaa

SEQ ID NO: 10057113 - DNA, 22 bp, Homo sapiens
tctgctcacatggctccatgca

SEQ ID NO: 10057114 - DNA, 22 bp, Homo sapiens
tctgctcagggagggtcactac

SEQ ID NO: 10057115 - DNA, 22 bp, Homo sapiens
tctgcctgctaactcctgcacc

SEQ ID NO: 10057116 - DNA, 22 bp, Homo sapiens
tctgggaaggctctgcagatat

SEQ ID NO: 10057117 - DNA, 22 bp, Homo sapiens
tctggctctctcatcacccaat

SEQ ID NO: 10057118 - DNA, 22 bp, Homo sapiens
tctgggagtttctgtgggagct

SEQ ID NO: 10057119 - DNA, 22 bp, Homo sapiens
tctgggcaatggatgcactcac

SEQ ID NO: 10057120 - DNA, 22 bp, Homo sapiens
tctgggcagttcggatcctctg

SEQ ID NO: 10057121 - DNA, 22 bp, Homo sapiens
tctgggaggtactgggaggtgt

SEQ ID NO: 10057122 - DNA, 22 bp, Homo sapiens
tctggatggtcagctcttcctg

SEQ ID NO: 10057123 - DNA, 22 bp, Homo sapiens
tctggagatcatgtggggtgga

SEQ ID NO: 10057124 - DNA, 22 bp, Homo sapiens
tctgctgcagagctgcgggtgc

SEQ ID NO: 10057125 - DNA, 22 bp, Homo sapiens
tctgctgcacaaattcatctct

SEQ ID NO: 10057126 - DNA, 22 bp, Homo sapiens
tctgctgcagcaggattctctg

SEQ ID NO: 10057127 - DNA, 22 bp, Homo sapiens
tctgctgccaccttgtggtgag

SEQ ID NO: 10057128 - DNA, 22 bp, Homo sapiens
tctgctgcagggaaagactttc

SEQ ID NO: 10057129 - DNA, 22 bp, Homo sapiens
tctgctgcctgcagggcagaga

SEQ ID NO: 10057130 - DNA, 22 bp, Homo sapiens
tctgctgccatgcagagcagta

SEQ ID NO: 10057131 - DNA, 22 bp, Homo sapiens
tctgctgcctcggtgtgggtac

SEQ ID NO: 10057132 - DNA, 22 bp, Homo sapiens
tctgctgctacagactctctag

SEQ ID NO: 10057133 - DNA, 22 bp, Homo sapiens
tctgctggtgatgacctcataa

SEQ ID NO: 10057134 - DNA, 22 bp, Homo sapiens
tctgctgctgcagctacactat

SEQ ID NO: 10057135 - DNA, 22 bp, Homo sapiens
tctgctgctgagcacactccta

SEQ ID NO: 10057136 - DNA, 22 bp, Homo sapiens
tctgctgctgaccaacactgtg

SEQ ID NO: 10057137 - DNA, 18 bp, Homo sapiens
tctgctgctgcgtcctgc

SEQ ID NO: 10057138 - DNA, 22 bp, Homo sapiens
tctgctgtctatgcaagtcctt

SEQ ID NO: 10057139 - DNA, 22 bp, Homo sapiens
tctggagataagacagacagat

SEQ ID NO: 10057140 - DNA, 22 bp, Homo sapiens
tctggagaggaggatgtggaca

SEQ ID NO: 10057141 - DNA, 22 bp, Homo sapiens
tctggagaagcccagggagctg

SEQ ID NO: 10057142 - DNA, 22 bp, Homo sapiens
tctcctgctcccaactgctgca

SEQ ID NO: 10057143 - DNA, 22 bp, Homo sapiens
tctcctgcttcaactgatggac

SEQ ID NO: 10057144 - DNA, 22 bp, Homo sapiens
tctcctgcagcgagcccgacac

SEQ ID NO: 10057145 - DNA, 22 bp, Homo sapiens
tctcctgcagtcagcagtctca

SEQ ID NO: 10057146 - DNA, 22 bp, Homo sapiens
tctcctgctcagaacagcctca

SEQ ID NO: 10057147 - DNA, 22 bp, Homo sapiens
tctcctgctcagaacagcctca

SEQ ID NO: 10057148 - DNA, 22 bp, Homo sapiens
tctcctgccactgcttcccatt

SEQ ID NO: 10057149 - DNA, 23 bp, Homo sapiens
tctcctcctagatacagtcatgg

SEQ ID NO: 10057150 - DNA, 23 bp, Homo sapiens
tctcctcctagatacagtcatgg

SEQ ID NO: 10057151 - DNA, 22 bp, Homo sapiens
tctcctcccaggctcttccagg

SEQ ID NO: 10057152 - DNA, 22 bp, Homo sapiens
tctctaaacttatatgaactat

SEQ ID NO: 10057153 - DNA, 22 bp, Homo sapiens
tctccccagctgagctgccctt

SEQ ID NO: 10057154 - DNA, 22 bp, Homo sapiens
tctccccaaaggactcactctc

SEQ ID NO: 10057155 - DNA, 22 bp, Homo sapiens
tctccccaaccatggcactcac

SEQ ID NO: 10057156 - DNA, 21 bp, Homo sapiens
tctccccattcttattcccat

SEQ ID NO: 10057157 - DNA, 22 bp, Homo sapiens
tctcccctgttggccaggtttt

SEQ ID NO: 10057158 - DNA, 22 bp, Homo sapiens
tctcccaggctggagtgcagtg

SEQ ID NO: 10057159 - DNA, 22 bp, Homo sapiens
tctcccaggcaggagtgcagtg

SEQ ID NO: 10057160 - DNA, 22 bp, Homo sapiens
tctcccactgcaagcccaggct

SEQ ID NO: 10057161 - DNA, 22 bp, Homo sapiens
tctcaccatcttgaatccctta

SEQ ID NO: 10057162 - DNA, 22 bp, Homo sapiens
tctcaccaaagccttgaccata

SEQ ID NO: 10057163 - DNA, 22 bp, Homo sapiens
tctcagagtgacaatgagaatt

SEQ ID NO: 10057164 - DNA, 22 bp, Homo sapiens
tctcagagtttagagctgagcc

SEQ ID NO: 10057165 - DNA, 22 bp, Homo sapiens
tctcaggtaagcttctttgatg

SEQ ID NO: 10057166 - DNA, 22 bp, Homo sapiens
tctcatcacacagccagtatgt

SEQ ID NO: 10057167 - DNA, 22 bp, Homo sapiens
tctcattgccttcactcttcag

SEQ ID NO: 10057168 - DNA, 22 bp, Homo sapiens
tctcattgtccaattgaattta

SEQ ID NO: 10057169 - DNA, 22 bp, Homo sapiens
tctcattggtatgatgtgtaga

SEQ ID NO: 10057170 - DNA, 22 bp, Homo sapiens
tctcattggtatatacatgtgt

SEQ ID NO: 10057171 - DNA, 22 bp, Homo sapiens
tctcattggaaaagagtttaat

SEQ ID NO: 10057172 - DNA, 22 bp, Homo sapiens
tctccaaggccctactctattt

SEQ ID NO: 10057173 - DNA, 20 bp, Homo sapiens
tctcttttagcttacagctg

SEQ ID NO: 10057174 - DNA, 22 bp, Homo sapiens
tctctttgtggccaggagagga

SEQ ID NO: 10057175 - DNA, 22 bp, Homo sapiens
tctctttaaagactcagagatt

SEQ ID NO: 10057176 - DNA, 22 bp, Homo sapiens
tctctttaagtataatcttata

SEQ ID NO: 10057177 - DNA, 23 bp, Homo sapiens
tctctttcaagagcttaatgtgc

SEQ ID NO: 10057178 - DNA, 22 bp, Homo sapiens
tctctgtggcaagcatgctgct

SEQ ID NO: 10057179 - DNA, 22 bp, Homo sapiens
tctctgtgcaggatgctgagtt

SEQ ID NO: 10057180 - DNA, 22 bp, Homo sapiens
tctctgtggtgggaggctgagt

SEQ ID NO: 10057181 - DNA, 21 bp, Homo sapiens
tctctgtgtctttaagctgga

SEQ ID NO: 10057182 - DNA, 22 bp, Homo sapiens
tctcttaattttggaatagtgt

SEQ ID NO: 10057183 - DNA, 22 bp, Homo sapiens
tctcttcccggataaagtaagt

SEQ ID NO: 10057184 - DNA, 22 bp, Homo sapiens
tctcttcccctttcctttaaca

SEQ ID NO: 10057185 - DNA, 22 bp, Homo sapiens
tctcttctaacactagaaattc

SEQ ID NO: 10057186 - DNA, 22 bp, Homo sapiens
tctcttcctagtgatgggcttt

SEQ ID NO: 10057187 - DNA, 18 bp, Homo sapiens
tctcttcttggcagtcaa

SEQ ID NO: 10057188 - DNA, 22 bp, Homo sapiens
tctcttctatttgagactattt

SEQ ID NO: 10057189 - DNA, 22 bp, Homo sapiens
tctctgctctgtgcctcagttt

SEQ ID NO: 10057190 - DNA, 20 bp, Homo sapiens
tctctgctgtccacatttgc

SEQ ID NO: 10057191 - DNA, 22 bp, Homo sapiens
tctctcaacctcggcactattg

SEQ ID NO: 10057192 - DNA, 22 bp, Homo sapiens
tctctctcagccattacagaac

SEQ ID NO: 10057193 - DNA, 22 bp, Homo sapiens
tctctctttttaatcatgtaat

SEQ ID NO: 10057194 - DNA, 22 bp, Homo sapiens
tctctgagtcaccgtggagacg

SEQ ID NO: 10057195 - DNA, 22 bp, Homo sapiens
tccttgcaaatagctttctgag

SEQ ID NO: 10057196 - DNA, 19 bp, Homo sapiens
tccttcagtcagatctggg

SEQ ID NO: 10057197 - DNA, 22 bp, Homo sapiens
tccttcagggttgaggccgact

SEQ ID NO: 10057198 - DNA, 22 bp, Homo sapiens
tccttcagggggccgcctgcac

SEQ ID NO: 10057199 - DNA, 22 bp, Homo sapiens
tccttaggtatttagcatgaat

SEQ ID NO: 10057200 - DNA, 21 bp, Homo sapiens
tccttatatttgaatacttta

SEQ ID NO: 10057201 - DNA, 22 bp, Homo sapiens
tccttaattctgtgcaatatgt

SEQ ID NO: 10057202 - DNA, 22 bp, Homo sapiens
tccttaatatggaagagttctc

SEQ ID NO: 10057203 - DNA, 22 bp, Homo sapiens
tccttagacaaagagtgggctt

SEQ ID NO: 10057204 - DNA, 17 bp, Homo sapiens
tccttcagggcctcaca

SEQ ID NO: 10057205 - DNA, 22 bp, Homo sapiens
tccttcagggctgaccacaggc

SEQ ID NO: 10057206 - DNA, 20 bp, Homo sapiens
tccttcaggcagggcctagt

SEQ ID NO: 10057207 - DNA, 22 bp, Homo sapiens
tccttcaggcctcattctcata

SEQ ID NO: 10057208 - DNA, 23 bp, Homo sapiens
tccttcaggctcttcccctggac

SEQ ID NO: 10057209 - DNA, 22 bp, Homo sapiens
tccttcagctactcagtttcca

SEQ ID NO: 10057210 - DNA, 22 bp, Homo sapiens
tccttcagccatgggctctcca

SEQ ID NO: 10057211 - DNA, 22 bp, Homo sapiens
tccttcagcctcccagctcaaa

SEQ ID NO: 10057212 - DNA, 22 bp, Homo sapiens
tccttcagcttgttagagtgac

SEQ ID NO: 10057213 - DNA, 22 bp, Homo sapiens
tccttcagcttatttcttagga

SEQ ID NO: 10057214 - DNA, 22 bp, Homo sapiens
tccttcagctctctatttagat

SEQ ID NO: 10057215 - DNA, 22 bp, Homo sapiens
tccttcagctgctaggaaatga

SEQ ID NO: 10057216 - DNA, 22 bp, Homo sapiens
tccttcagattcctgcttctgg

SEQ ID NO: 10057217 - DNA, 22 bp, Homo sapiens
tccttcagaggacggcagccag

SEQ ID NO: 10057218 - DNA, 22 bp, Homo sapiens
tccttcagaggataaggaagaa

SEQ ID NO: 10057219 - DNA, 20 bp, Homo sapiens
tccttcagacgacaagcaag

SEQ ID NO: 10057220 - DNA, 22 bp, Homo sapiens
tccttcagaacctgtgatggaa

SEQ ID NO: 10057221 - DNA, 22 bp, Homo sapiens
tccttcagaaaacctcagtctt

SEQ ID NO: 10057222 - DNA, 23 bp, Homo sapiens
tccttcagagcctccctccaagc

SEQ ID NO: 10057223 - DNA, 20 bp, Homo sapiens
tccttcagactttggagttg

SEQ ID NO: 10057224 - DNA, 19 bp, Homo sapiens
tcgcagacctgagttctaa

SEQ ID NO: 10057225 - DNA, 20 bp, Homo sapiens
tcgtttatttgaaattgctc

SEQ ID NO: 10057226 - DNA, 22 bp, Homo sapiens
tcgtgtgtattccctctccttc

SEQ ID NO: 10057227 - DNA, 22 bp, Homo sapiens
tctaaacacgtctctttgaata

SEQ ID NO: 10057228 - DNA, 22 bp, Homo sapiens
tctaaacacgtctctttgaata

SEQ ID NO: 10057229 - DNA, 22 bp, Homo sapiens
tctaaacattatgatagtagag

SEQ ID NO: 10057230 - DNA, 22 bp, Homo sapiens
tctaaagatttggattcatttg

SEQ ID NO: 10057231 - DNA, 20 bp, Homo sapiens
tctaaagtacagtttgtgtg

SEQ ID NO: 10057232 - DNA, 22 bp, Homo sapiens
tctaaagccttccatataacgc

SEQ ID NO: 10057233 - DNA, 22 bp, Homo sapiens
tctaaacattggtatggagcag

SEQ ID NO: 10057234 - DNA, 22 bp, Homo sapiens
tcctttcttttctatgggccca

SEQ ID NO: 10057235 - DNA, 22 bp, Homo sapiens
tctatgtatatctttccattca

SEQ ID NO: 10057236 - DNA, 22 bp, Homo sapiens
tctatgttagagatacatccta

SEQ ID NO: 10057237 - DNA, 22 bp, Homo sapiens
tctattatggtacttatcatga

SEQ ID NO: 10057238 - DNA, 22 bp, Homo sapiens
tctataaagggccagatagtag

SEQ ID NO: 10057239 - DNA, 22 bp, Homo sapiens
tctcaaagtagctcccacagat

SEQ ID NO: 10057240 - DNA, 22 bp, Homo sapiens
tctcaaactaacaatgattata

SEQ ID NO: 10057241 - DNA, 22 bp, Homo sapiens
tctcaaactacagtatggctgt

SEQ ID NO: 10057242 - DNA, 22 bp, Homo sapiens
tctatttttatagttgaagtgc

SEQ ID NO: 10057243 - DNA, 22 bp, Homo sapiens
tctattttatactcaaatcttc

SEQ ID NO: 10057244 - DNA, 22 bp, Homo sapiens
tctatttaccaaatgtagttcc

SEQ ID NO: 10057245 - DNA, 22 bp, Homo sapiens
tctcacaccgtccctaaaccat

SEQ ID NO: 10057246 - DNA, 22 bp, Homo sapiens
tctaaatgtcagtacagaatga

SEQ ID NO: 10057247 - DNA, 22 bp, Homo sapiens
tctaattttggcattttaacct

SEQ ID NO: 10057248 - DNA, 20 bp, Homo sapiens
tctaattaaaattgtctagt

SEQ ID NO: 10057249 - DNA, 22 bp, Homo sapiens
tctacacaagtgagtggcacaa

SEQ ID NO: 10057250 - DNA, 22 bp, Homo sapiens
tctacacatttgtaaaggcatt

SEQ ID NO: 10057251 - DNA, 22 bp, Homo sapiens
tctacctggagtccgttgttaa

SEQ ID NO: 10057252 - DNA, 22 bp, Homo sapiens
tctacttttccctatacagttt

SEQ ID NO: 10057253 - DNA, 22 bp, Homo sapiens
tctaggagtaatgagctagcac

SEQ ID NO: 10057254 - DNA, 22 bp, Homo sapiens
tcctgtcttaatgatctcgtgc

SEQ ID NO: 10057255 - DNA, 22 bp, Homo sapiens
tcctgtctgtctttggtccctt

SEQ ID NO: 10057256 - DNA, 22 bp, Homo sapiens
tcctggggttttggccgcagct

SEQ ID NO: 10057257 - DNA, 20 bp, Homo sapiens
tcctggggtaagccatggtc

SEQ ID NO: 10057258 - DNA, 22 bp, Homo sapiens
tcctggggtcctgactgcttcc

SEQ ID NO: 10057259 - DNA, 19 bp, Homo sapiens
tcctggggatgtggtcacc

SEQ ID NO: 10057260 - DNA, 22 bp, Homo sapiens
tcctggggaggtcgaggctgag

SEQ ID NO: 10057261 - DNA, 22 bp, Homo sapiens
tcctggggccagcactggtgga

SEQ ID NO: 10057262 - DNA, 22 bp, Homo sapiens
tcctgctgttttctggcccaca

SEQ ID NO: 10057263 - DNA, 22 bp, Homo sapiens
tcctgctgggtctaactctggt

SEQ ID NO: 10057264 - DNA, 22 bp, Homo sapiens
taagaacagtgtctgtctcaca

SEQ ID NO: 10057265 - DNA, 23 bp, Homo sapiens
taagaacagacaagcatttacat

SEQ ID NO: 10057266 - DNA, 22 bp, Homo sapiens
taagaacattttcggaaagata

SEQ ID NO: 10057267 - DNA, 22 bp, Homo sapiens
tgagaatttgcatttctaacaa

SEQ ID NO: 10057268 - DNA, 22 bp, Homo sapiens
tgagacactctcgggcacattt

SEQ ID NO: 10057269 - DNA, 22 bp, Homo sapiens
tgagaagatttgctcttctgag

SEQ ID NO: 10057270 - DNA, 22 bp, Homo sapiens
tgagaactggtagcacttgtga

SEQ ID NO: 10057271 - DNA, 22 bp, Homo sapiens
tgagaactggtttctattcatg

SEQ ID NO: 10057272 - DNA, 18 bp, Homo sapiens
tgagaactaggcattgca

SEQ ID NO: 10057273 - DNA, 22 bp, Homo sapiens
tgagaggtaggaaatgaacaag

SEQ ID NO: 10057274 - DNA, 22 bp, Homo sapiens
tgagaggcagaatggtgcctgc

SEQ ID NO: 10057275 - DNA, 21 bp, Homo sapiens
tgagagagtagcaggacatat

SEQ ID NO: 10057276 - DNA, 22 bp, Homo sapiens
tgagatcattgacttgttcctg

SEQ ID NO: 10057277 - DNA, 22 bp, Homo sapiens
tgagatggggagggctgcagaa

SEQ ID NO: 10057278 - DNA, 22 bp, Homo sapiens
tgagccagagaggttgaggcta

SEQ ID NO: 10057279 - DNA, 22 bp, Homo sapiens
tgagcagtggtgtttttctatc

SEQ ID NO: 10057280 - DNA, 22 bp, Homo sapiens
tgagccagcctcagaagtcacg

SEQ ID NO: 10057281 - DNA, 22 bp, Homo sapiens
tgagcagagcagtaacaggagc

SEQ ID NO: 10057282 - DNA, 22 bp, Homo sapiens
tgagcagaggccagcacctggg

SEQ ID NO: 10057283 - DNA, 22 bp, Homo sapiens
tgagcagaggccagcacctggg

SEQ ID NO: 10057284 - DNA, 22 bp, Homo sapiens
tgagcagagttgtttctcctga

SEQ ID NO: 10057285 - DNA, 22 bp, Homo sapiens
tgagcagagatgactgggcatt

SEQ ID NO: 10057286 - DNA, 22 bp, Homo sapiens
tgagcagcttgttccgagtgtt

SEQ ID NO: 10057287 - DNA, 22 bp, Homo sapiens
tgagcaggactcactgcagcct

SEQ ID NO: 10057288 - DNA, 22 bp, Homo sapiens
tgagcagatttgttctaggggt

SEQ ID NO: 10057289 - DNA, 22 bp, Homo sapiens
tgagcaggcgcagcaggaggtc

SEQ ID NO: 10057290 - DNA, 22 bp, Homo sapiens
tgagccgtggtctctgagggtg

SEQ ID NO: 10057291 - DNA, 22 bp, Homo sapiens
tgagccgtggtctctgagggtg

SEQ ID NO: 10057292 - DNA, 22 bp, Homo sapiens
tgagccagtctctcagaaccct

SEQ ID NO: 10057293 - DNA, 22 bp, Homo sapiens
tgagccaggttaagacaggagc

SEQ ID NO: 10057294 - DNA, 22 bp, Homo sapiens
tgagcctgcctgcaggtgtgct

SEQ ID NO: 10057295 - DNA, 22 bp, Homo sapiens
tgagcctgagttcaaggctgca

SEQ ID NO: 10057296 - DNA, 22 bp, Homo sapiens
tgagcctgtcctgtgcatgtga

SEQ ID NO: 10057297 - DNA, 22 bp, Homo sapiens
tgagctttgtgggtaaagagag

SEQ ID NO: 10057298 - DNA, 22 bp, Homo sapiens
tgagctttcatgtatgaaaaga

SEQ ID NO: 10057299 - DNA, 22 bp, Homo sapiens
tgagctgtgtcctgggggcagt

SEQ ID NO: 10057300 - DNA, 22 bp, Homo sapiens
tgagcttattcataaaagtgca

SEQ ID NO: 10057301 - DNA, 22 bp, Homo sapiens
tgagcttatacatgtgaagtca

SEQ ID NO: 10057302 - DNA, 22 bp, Homo sapiens
tgagctggttcttgaggcatga

SEQ ID NO: 10057303 - DNA, 22 bp, Homo sapiens
tgagctggtcttgagtgtagct

SEQ ID NO: 10057304 - DNA, 19 bp, Homo sapiens
tgaggccagctggcatttt

SEQ ID NO: 10057305 - DNA, 18 bp, Homo sapiens
tgaggccagagtgggcat

SEQ ID NO: 10057306 - DNA, 22 bp, Homo sapiens
tgaggccaatgaccctgggcag

SEQ ID NO: 10057307 - DNA, 22 bp, Homo sapiens
tgaggccaactagggagatgga

SEQ ID NO: 10057308 - DNA, 22 bp, Homo sapiens
tgaggccaagaaaagctgggtg

SEQ ID NO: 10057309 - DNA, 22 bp, Homo sapiens
tgaggcaggagaatggcgggaa

SEQ ID NO: 10057310 - DNA, 22 bp, Homo sapiens
tgagtcttctgcctaaagaagt

SEQ ID NO: 10057311 - DNA, 22 bp, Homo sapiens
tgaggtggctagggaggcactc

SEQ ID NO: 10057312 - DNA, 22 bp, Homo sapiens
tgaggtggccgaggagcaggac

SEQ ID NO: 10057313 - DNA, 19 bp, Homo sapiens
tgaggggctcacagtctca

SEQ ID NO: 10057314 - DNA, 22 bp, Homo sapiens
tgaggggcggcctgcagaggcc

SEQ ID NO: 10057315 - DNA, 22 bp, Homo sapiens
tgaggggccagaccccacctag

SEQ ID NO: 10057316 - DNA, 22 bp, Homo sapiens
tgaggggcatgtgtttacacat

SEQ ID NO: 10057317 - DNA, 22 bp, Homo sapiens
tgaggggcgctggcaggttcct

SEQ ID NO: 10057318 - DNA, 22 bp, Homo sapiens
tgagggggttaattaggagagt

SEQ ID NO: 10057319 - DNA, 22 bp, Homo sapiens
tgaggggggtaatcactgggtt

SEQ ID NO: 10057320 - DNA, 18 bp, Homo sapiens
tgaggtagctttcctcct

SEQ ID NO: 10057321 - DNA, 22 bp, Homo sapiens
tgagggaggccctttgagcaga

SEQ ID NO: 10057322 - DNA, 22 bp, Homo sapiens
tgagggactcagaattcagcct

SEQ ID NO: 10057323 - DNA, 22 bp, Homo sapiens
tgagggagttgggtgtatagga

SEQ ID NO: 10057324 - DNA, 22 bp, Homo sapiens
tgaggggcagagaggtgtccag

SEQ ID NO: 10057325 - DNA, 22 bp, Homo sapiens
tgaggctcacgaacagaagact

SEQ ID NO: 10057326 - DNA, 22 bp, Homo sapiens
tgaggctcagaagtgccaagtg

SEQ ID NO: 10057327 - DNA, 22 bp, Homo sapiens
tgacaaaactgcaattactttt

SEQ ID NO: 10057328 - DNA, 22 bp, Homo sapiens
tgacacaaaggaaagcataatc

SEQ ID NO: 10057329 - DNA, 22 bp, Homo sapiens
tgaatgcttggagtcataaaat

SEQ ID NO: 10057330 - DNA, 22 bp, Homo sapiens
tgaatgtgatgctaaacatatg

SEQ ID NO: 10057331 - DNA, 22 bp, Homo sapiens
tgaatgtgatgctaaacatatg

SEQ ID NO: 10057332 - DNA, 22 bp, Homo sapiens
tgaataatcttgggtattaata

SEQ ID NO: 10057333 - DNA, 22 bp, Homo sapiens
tgaataaactatgaggaggaat

SEQ ID NO: 10057334 - DNA, 22 bp, Homo sapiens
tgacaggctaggaggctgaagg

SEQ ID NO: 10057335 - DNA, 22 bp, Homo sapiens
tgacaggggctggtggataaat

SEQ ID NO: 10057336 - DNA, 22 bp, Homo sapiens
tgacagaccactgcaactctgt

SEQ ID NO: 10057337 - DNA, 22 bp, Homo sapiens
tgacacagattagagacatacc

SEQ ID NO: 10057338 - DNA, 22 bp, Homo sapiens
tgacatttatcaaagaaatggt

SEQ ID NO: 10057339 - DNA, 22 bp, Homo sapiens
tgacatttatcaaagaaatggt

SEQ ID NO: 10057340 - DNA, 22 bp, Homo sapiens
tgacatttatcttctacaatga

SEQ ID NO: 10057341 - DNA, 21 bp, Homo sapiens
tgacatttccaatataaagcc

SEQ ID NO: 10057342 - DNA, 22 bp, Homo sapiens
tgacatttaagcctctgatttc

SEQ ID NO: 10057343 - DNA, 22 bp, Homo sapiens
tgacattgtgtgcatttaaagt

SEQ ID NO: 10057344 - DNA, 22 bp, Homo sapiens
tgacatttcggtgtatgtgatg

SEQ ID NO: 10057345 - DNA, 22 bp, Homo sapiens
tgacattttatcaatatcacag

SEQ ID NO: 10057346 - DNA, 22 bp, Homo sapiens
tgacctattagatttccttgcc

SEQ ID NO: 10057347 - DNA, 21 bp, Homo sapiens
tgactaattgtgataaagtgc

SEQ ID NO: 10057348 - DNA, 22 bp, Homo sapiens
tgactcacagtggagaaagagg

SEQ ID NO: 10057349 - DNA, 22 bp, Homo sapiens
tgactgtgcaagcagagagcat

SEQ ID NO: 10057350 - DNA, 22 bp, Homo sapiens
tgactgtgccgtgcccctagga

SEQ ID NO: 10057351 - DNA, 22 bp, Homo sapiens
tgactgccgattgtccttctct

SEQ ID NO: 10057352 - DNA, 22 bp, Homo sapiens
tgactgccccttccattcctgc

SEQ ID NO: 10057353 - DNA, 22 bp, Homo sapiens
tgactgccgattgtccttctct

SEQ ID NO: 10057354 - DNA, 22 bp, Homo sapiens
tcttttatcctacatttagctc

SEQ ID NO: 10057355 - DNA, 22 bp, Homo sapiens
tcttttgtggatgaagaaatgg

SEQ ID NO: 10057356 - DNA, 21 bp, Homo sapiens
tcttttctcagctttgtggtt

SEQ ID NO: 10057357 - DNA, 22 bp, Homo sapiens
tctttgttattgctttatctat

SEQ ID NO: 10057358 - DNA, 20 bp, Homo sapiens
tctttgttaattttatctcc

SEQ ID NO: 10057359 - DNA, 22 bp, Homo sapiens
tctttgtttgcctttatcaaga

SEQ ID NO: 10057360 - DNA, 18 bp, Homo sapiens
tctttgtttccttcttgc

SEQ ID NO: 10057361 - DNA, 22 bp, Homo sapiens
tctttgtttgtactgttagaat

SEQ ID NO: 10057362 - DNA, 22 bp, Homo sapiens
tcttttaagcctctggcatagg

SEQ ID NO: 10057363 - DNA, 22 bp, Homo sapiens
tcttttaacctaactagcttgg

SEQ ID NO: 10057364 - DNA, 22 bp, Homo sapiens
tcttttatagtgaattttcttg

SEQ ID NO: 10057365 - DNA, 22 bp, Homo sapiens
tctttggagtgttatcagtaat

SEQ ID NO: 10057366 - DNA, 22 bp, Homo sapiens
tctttgtggcgggcttaaatac

SEQ ID NO: 10057367 - DNA, 22 bp, Homo sapiens
tctttgcatgtgcttcttggcc

SEQ ID NO: 10057368 - DNA, 22 bp, Homo sapiens
tctttgctattgtgaatagtgc

SEQ ID NO: 10057369 - DNA, 22 bp, Homo sapiens
tctttgcacacagcgattcttc

SEQ ID NO: 10057370 - DNA, 22 bp, Homo sapiens
tctttgattttgttactaagac

SEQ ID NO: 10057371 - DNA, 22 bp, Homo sapiens
tcttttgttgcctacttattaa

SEQ ID NO: 10057372 - DNA, 22 bp, Homo sapiens
tctttttttcctgtgcagagct

SEQ ID NO: 10057373 - DNA, 22 bp, Homo sapiens
tgaaaatatagttttccagact

SEQ ID NO: 10057374 - DNA, 22 bp, Homo sapiens
tgaaaattcatctcatagcaga

SEQ ID NO: 10057375 - DNA, 22 bp, Homo sapiens
tgaaaatttccatcagttatat

SEQ ID NO: 10057376 - DNA, 22 bp, Homo sapiens
tgaaaggtgtccaatatttctc

SEQ ID NO: 10057377 - DNA, 22 bp, Homo sapiens
tgaaaggttaaaagtagtattg

SEQ ID NO: 10057378 - DNA, 22 bp, Homo sapiens
tgaaatgctgtagagactgtat

SEQ ID NO: 10057379 - DNA, 22 bp, Homo sapiens
tgaaatgaaacagaacatatca

SEQ ID NO: 10057380 - DNA, 22 bp, Homo sapiens
tgaaatgtacaagtgctttttt

SEQ ID NO: 10057381 - DNA, 22 bp, Homo sapiens
tgaaatgtctttgcaattgaaa

SEQ ID NO: 10057382 - DNA, 22 bp, Homo sapiens
tgaaatgtgatctgagcttggc

SEQ ID NO: 10057383 - DNA, 22 bp, Homo sapiens
tgaaatgtctgaaagccaatct

SEQ ID NO: 10057384 - DNA, 22 bp, Homo sapiens
tgaaatgtgttatctgggcctg

SEQ ID NO: 10057385 - DNA, 22 bp, Homo sapiens
tgaaatgtgtccatgttatttc

SEQ ID NO: 10057386 - DNA, 22 bp, Homo sapiens
tgaaatgtcagtgttttataag

SEQ ID NO: 10057387 - DNA, 23 bp, Homo sapiens
tgaaatgtagaggaattccacct

SEQ ID NO: 10057388 - DNA, 22 bp, Homo sapiens
tgaaatgtttgaagaccactga

SEQ ID NO: 10057389 - DNA, 22 bp, Homo sapiens
tgaaatgttggtaattttatat

SEQ ID NO: 10057390 - DNA, 22 bp, Homo sapiens
tgaaatgtttaggaccactaga

SEQ ID NO: 10057391 - DNA, 22 bp, Homo sapiens
tgaaatgttaatcacacaaagg

SEQ ID NO: 10057392 - DNA, 22 bp, Homo sapiens
tgaaatgtgttctagtgttttg

SEQ ID NO: 10057393 - DNA, 22 bp, Homo sapiens
tgaaattccaggagagttaaaa

SEQ ID NO: 10057394 - DNA, 22 bp, Homo sapiens
tgaaattagtgaagttacagtt

SEQ ID NO: 10057395 - DNA, 22 bp, Homo sapiens
tgaaattattcttaccaaggtg

SEQ ID NO: 10057396 - DNA, 22 bp, Homo sapiens
tgaaattatgcattgttgtacc

SEQ ID NO: 10057397 - DNA, 22 bp, Homo sapiens
tgaacaaatggaaataaccagt

SEQ ID NO: 10057398 - DNA, 22 bp, Homo sapiens
tgaagcaaattgtttagcctga

SEQ ID NO: 10057399 - DNA, 20 bp, Homo sapiens
tgcccacatcactcaggagt

SEQ ID NO: 10057400 - DNA, 22 bp, Homo sapiens
tgccatggaatcacctccagct

SEQ ID NO: 10057401 - DNA, 18 bp, Homo sapiens
tgcccagaaaagcaggga

SEQ ID NO: 10057402 - DNA, 18 bp, Homo sapiens
tgcccaccagaagaggga

SEQ ID NO: 10057403 - DNA, 22 bp, Homo sapiens
tgcccacattcaaaaggtgatg

SEQ ID NO: 10057404 - DNA, 20 bp, Homo sapiens
tgcccagcaagagtgcagtt

SEQ ID NO: 10057405 - DNA, 20 bp, Homo sapiens
tgccccaggcctgcacctgc

SEQ ID NO: 10057406 - DNA, 22 bp, Homo sapiens
tgccccagactctgctcacctc

SEQ ID NO: 10057407 - DNA, 22 bp, Homo sapiens
tgccccagacctactgaatggg

SEQ ID NO: 10057408 - DNA, 20 bp, Homo sapiens
tgccaggcacggagtgcatg

SEQ ID NO: 10057409 - DNA, 22 bp, Homo sapiens
tgccaggccctgtgctggatgc

SEQ ID NO: 10057410 - DNA, 22 bp, Homo sapiens
tgccatccaacagttccatctt

SEQ ID NO: 10057411 - DNA, 22 bp, Homo sapiens
tgccatccttgaggaagggcaa

SEQ ID NO: 10057412 - DNA, 22 bp, Homo sapiens
tgccatcctgtgtcatgctcat

SEQ ID NO: 10057413 - DNA, 22 bp, Homo sapiens
tgcctccctctctgccactgga

SEQ ID NO: 10057414 - DNA, 22 bp, Homo sapiens
tgcctctctaacccatgcccaa

SEQ ID NO: 10057415 - DNA, 19 bp, Homo sapiens
tgcctcagggctttgagga

SEQ ID NO: 10057416 - DNA, 22 bp, Homo sapiens
tgcctcagagtgggcttgctat

SEQ ID NO: 10057417 - DNA, 22 bp, Homo sapiens
tgcctgccaggcaacctgggag

SEQ ID NO: 10057418 - DNA, 22 bp, Homo sapiens
tgcctgcccacgactacagcag

SEQ ID NO: 10057419 - DNA, 20 bp, Homo sapiens
tgcctgcccaggtcctgcac

SEQ ID NO: 10057420 - DNA, 20 bp, Homo sapiens
tgcctgcccaggtcctgcac

SEQ ID NO: 10057421 - DNA, 22 bp, Homo sapiens
tgccctgcagtgagtgcgtctg

SEQ ID NO: 10057422 - DNA, 22 bp, Homo sapiens
tgcccgtggcctggggcagctt

SEQ ID NO: 10057423 - DNA, 22 bp, Homo sapiens
tgccctggaaatgagaggtgtg

SEQ ID NO: 10057424 - DNA, 22 bp, Homo sapiens
tgccctgcttctcttgggacag

SEQ ID NO: 10057425 - DNA, 22 bp, Homo sapiens
tgccctgctgtggctctgccca

SEQ ID NO: 10057426 - DNA, 22 bp, Homo sapiens
tgccctggaaccatctacagtc

SEQ ID NO: 10057427 - DNA, 22 bp, Homo sapiens
tgccctggatgctgcaggtgtg

SEQ ID NO: 10057428 - DNA, 22 bp, Homo sapiens
tgcctaaaccattccccttcct

SEQ ID NO: 10057429 - DNA, 22 bp, Homo sapiens
tgccgtggggctgaggctggag

SEQ ID NO: 10057430 - DNA, 22 bp, Homo sapiens
tgccgtggggctgaggctggag

SEQ ID NO: 10057431 - DNA, 22 bp, Homo sapiens
tgccgcagtgcggggagggccc

SEQ ID NO: 10057432 - DNA, 22 bp, Homo sapiens
tgcctcagagacctgacagtac

SEQ ID NO: 10057433 - DNA, 22 bp, Homo sapiens
tgccctgggacatgcagcggag

SEQ ID NO: 10057434 - DNA, 22 bp, Homo sapiens
tgcccttcctctggattgcctt

SEQ ID NO: 10057435 - DNA, 22 bp, Homo sapiens
tgcagttcaaggttgtacagct

SEQ ID NO: 10057436 - DNA, 22 bp, Homo sapiens
tgcagttctaagtagacaagtc

SEQ ID NO: 10057437 - DNA, 22 bp, Homo sapiens
tgcatatacccgcatttacata

SEQ ID NO: 10057438 - DNA, 22 bp, Homo sapiens
tgcatcagtgactgaatatgag

SEQ ID NO: 10057439 - DNA, 22 bp, Homo sapiens
tgcatcttacgttttgaaaggg

SEQ ID NO: 10057440 - DNA, 22 bp, Homo sapiens
tgcatctttctgcatatgtaaa

SEQ ID NO: 10057441 - DNA, 22 bp, Homo sapiens
tgcattcatcatttgaaagccc

SEQ ID NO: 10057442 - DNA, 17 bp, Homo sapiens
tgcatgtcctttgttcc

SEQ ID NO: 10057443 - DNA, 22 bp, Homo sapiens
tgcatttttgaggttaactcaa

SEQ ID NO: 10057444 - DNA, 22 bp, Homo sapiens
tgcattttacttacctgttagt

SEQ ID NO: 10057445 - DNA, 22 bp, Homo sapiens
tgcatttagttttaataaagga

SEQ ID NO: 10057446 - DNA, 22 bp, Homo sapiens
tgcatttatggagcaaggcagt

SEQ ID NO: 10057447 - DNA, 22 bp, Homo sapiens
tgcatttacctggaggtcattt

SEQ ID NO: 10057448 - DNA, 22 bp, Homo sapiens
tgccaccaggagaaccagtgca

SEQ ID NO: 10057449 - DNA, 22 bp, Homo sapiens
tgccaccaggagaaccagtgca

SEQ ID NO: 10057450 - DNA, 22 bp, Homo sapiens
tgccacagggtcctcaggccag

SEQ ID NO: 10057451 - DNA, 22 bp, Homo sapiens
tgccagagaagacccagtcact

SEQ ID NO: 10057452 - DNA, 22 bp, Homo sapiens
tgccactggacccagaactctt

SEQ ID NO: 10057453 - DNA, 22 bp, Homo sapiens
tgccacctgtacatgctatctg

SEQ ID NO: 10057454 - DNA, 22 bp, Homo sapiens
tgccagagatttcacactgcta

SEQ ID NO: 10057455 - DNA, 22 bp, Homo sapiens
tgccagagttacatgagggtca

SEQ ID NO: 10057456 - DNA, 22 bp, Homo sapiens
tgccagcacaagttaagagatc

SEQ ID NO: 10057457 - DNA, 22 bp, Homo sapiens
tgccagcagtagcagtaggcca

SEQ ID NO: 10057458 - DNA, 22 bp, Homo sapiens
tgccagcagaaataaatacttg

SEQ ID NO: 10057459 - DNA, 22 bp, Homo sapiens
tgcaggtaggcctgacttccag

SEQ ID NO: 10057460 - DNA, 22 bp, Homo sapiens
tgcaggggcttgtctgggcctg

SEQ ID NO: 10057461 - DNA, 22 bp, Homo sapiens
tgcaggctggcagtgctgaaat

SEQ ID NO: 10057462 - DNA, 22 bp, Homo sapiens
tgcaaaagaatatagatattgt

SEQ ID NO: 10057463 - DNA, 22 bp, Homo sapiens
tgatttatgcattatactgttg

SEQ ID NO: 10057464 - DNA, 19 bp, Homo sapiens
tgcaaatgtaggaagaata

SEQ ID NO: 10057465 - DNA, 19 bp, Homo sapiens
tgcaaattctaaaaactga

SEQ ID NO: 10057466 - DNA, 22 bp, Homo sapiens
tgcaaattcagaagaactgccc

SEQ ID NO: 10057467 - DNA, 22 bp, Homo sapiens
tgcaaattccatttaaacacta

SEQ ID NO: 10057468 - DNA, 22 bp, Homo sapiens
tgcaaatttaatgaaactatgt

SEQ ID NO: 10057469 - DNA, 22 bp, Homo sapiens
tgcaaattgcgatttttattag

SEQ ID NO: 10057470 - DNA, 22 bp, Homo sapiens
tgcaaagatgaaatattaaagg

SEQ ID NO: 10057471 - DNA, 19 bp, Homo sapiens
tgcaaatgctgttgagaat

SEQ ID NO: 10057472 - DNA, 22 bp, Homo sapiens
tgcaaatttgacttcacacatc

SEQ ID NO: 10057473 - DNA, 22 bp, Homo sapiens
tgcaaatttgagcagactgttc

SEQ ID NO: 10057474 - DNA, 22 bp, Homo sapiens
tgcacacacatgaagtagcatg

SEQ ID NO: 10057475 - DNA, 22 bp, Homo sapiens
tgcacacaccgtgcttcactga

SEQ ID NO: 10057476 - DNA, 19 bp, Homo sapiens
tgcacacagataagtatct

SEQ ID NO: 10057477 - DNA, 22 bp, Homo sapiens
tgcacacactcgtgtatatgag

SEQ ID NO: 10057478 - DNA, 22 bp, Homo sapiens
tgcaattagcgtattagtttat

SEQ ID NO: 10057479 - DNA, 22 bp, Homo sapiens
tgcaattagcattgtattctta

SEQ ID NO: 10057480 - DNA, 19 bp, Homo sapiens
tgagtgtgtgtttctctaa

SEQ ID NO: 10057481 - DNA, 22 bp, Homo sapiens
tgagttaaatgagaacatgaaa

SEQ ID NO: 10057482 - DNA, 21 bp, Homo sapiens
tgatcatttgtgtaaaggaga

SEQ ID NO: 10057483 - DNA, 22 bp, Homo sapiens
tgatctttactgctgtttataa

SEQ ID NO: 10057484 - DNA, 22 bp, Homo sapiens
tgatatttaagcaaaaatatgg

SEQ ID NO: 10057485 - DNA, 22 bp, Homo sapiens
tgatgaaaatgttcagcaatta

SEQ ID NO: 10057486 - DNA, 22 bp, Homo sapiens
tgatgaaagtgtttactcacct

SEQ ID NO: 10057487 - DNA, 22 bp, Homo sapiens
tgatgaaaaccagaactctcat

SEQ ID NO: 10057488 - DNA, 22 bp, Homo sapiens
tgatgaaaatatgattctgagg

SEQ ID NO: 10057489 - DNA, 22 bp, Homo sapiens
tgatcttttctatttatggtag

SEQ ID NO: 10057490 - DNA, 22 bp, Homo sapiens
tgatgctttaagattaatctgg

SEQ ID NO: 10057491 - DNA, 22 bp, Homo sapiens
tgatggaggacccagcgtggga

SEQ ID NO: 10057492 - DNA, 22 bp, Homo sapiens
tgatttaaaagaaacattgtct

SEQ ID NO: 10057493 - DNA, 22 bp, Homo sapiens
tgattgatacaactcaatccaa

SEQ ID NO: 10057494 - DNA, 22 bp, Homo sapiens
tgcagaaacagagttttgccat

SEQ ID NO: 10057495 - DNA, 22 bp, Homo sapiens
tgcagaaataaagatattatca

SEQ ID NO: 10057496 - DNA, 21 bp, Homo sapiens
tgcagaaagcggcttgaagca

SEQ ID NO: 10057497 - DNA, 22 bp, Homo sapiens
tgcagaaagcattgactcttcc

SEQ ID NO: 10057498 - DNA, 22 bp, Homo sapiens
tgcagaaataactcatattgca

SEQ ID NO: 10057499 - DNA, 21 bp, Homo sapiens
tgcagaaatggtttttctaag

SEQ ID NO: 10057500 - DNA, 22 bp, Homo sapiens
tgcagaaattcagaaagcataa

SEQ ID NO: 10057501 - DNA, 22 bp, Homo sapiens
tgcagaagaaaacagctgtgtg

SEQ ID NO: 10057502 - DNA, 22 bp, Homo sapiens
tgcaccagtttctcagagaatc

SEQ ID NO: 10057503 - DNA, 22 bp, Homo sapiens
tgcacacagttctcaggaaaga

SEQ ID NO: 10057504 - DNA, 22 bp, Homo sapiens
tgcacagctgcctcctctctgc

SEQ ID NO: 10057505 - DNA, 22 bp, Homo sapiens
tgcagagtcctctggagggact

SEQ ID NO: 10057506 - DNA, 22 bp, Homo sapiens
tgcagagtgggagaggtgcggg

SEQ ID NO: 10057507 - DNA, 22 bp, Homo sapiens
tgcagagtagtgaggggacaga

SEQ ID NO: 10057508 - DNA, 22 bp, Homo sapiens
tgcagcaccacacctggctaat

SEQ ID NO: 10057509 - DNA, 22 bp, Homo sapiens
tgcagaggagctggaaggctgg

SEQ ID NO: 10057510 - DNA, 22 bp, Homo sapiens
tgcagaggagctggaaggctgg

SEQ ID NO: 10057511 - DNA, 22 bp, Homo sapiens
tgcagagaaaccagtggaggac

SEQ ID NO: 10057512 - DNA, 22 bp, Homo sapiens
tgcagacaagtcgtgggatctt

SEQ ID NO: 10057513 - DNA, 22 bp, Homo sapiens
tgcaggagtccaatcaggagac

SEQ ID NO: 10057514 - DNA, 21 bp, Homo sapiens
tgcaggagtctgtgagtcagg

SEQ ID NO: 10057515 - DNA, 22 bp, Homo sapiens
tgcaggaagcaaccaggtccaa

SEQ ID NO: 10057516 - DNA, 22 bp, Homo sapiens
tgcaggaagacttcccaagcca

SEQ ID NO: 10057517 - DNA, 22 bp, Homo sapiens
tgcaggaacttggttttactca

SEQ ID NO: 10057518 - DNA, 22 bp, Homo sapiens
tgcaggaacataggttccttgg

SEQ ID NO: 10057519 - DNA, 22 bp, Homo sapiens
tgcaggaacagaactcactccc

SEQ ID NO: 10057520 - DNA, 22 bp, Homo sapiens
tgcaggaaaaccaacacgcctt

SEQ ID NO: 10057521 - DNA, 22 bp, Homo sapiens
tgcaggaaaacacctatcaccc

SEQ ID NO: 10057522 - DNA, 22 bp, Homo sapiens
tgcagccagactttgtgcgaaa

SEQ ID NO: 10057523 - DNA, 22 bp, Homo sapiens
tgcagcctggtggtcactggag

SEQ ID NO: 10057524 - DNA, 21 bp, Homo sapiens
tgcagcctctgcccagcagtg

SEQ ID NO: 10057525 - DNA, 22 bp, Homo sapiens
tgcagcctctctgcttcaggaa

SEQ ID NO: 10057526 - DNA, 22 bp, Homo sapiens
tgcagcaggcacaggacggaag

SEQ ID NO: 10057527 - DNA, 21 bp, Homo sapiens
tgcagcagatttgggggaaga

SEQ ID NO: 10057528 - DNA, 22 bp, Homo sapiens
tgcagccttggcaaccagggac

SEQ ID NO: 10057529 - DNA, 22 bp, Homo sapiens
tgcagccttgcctcctcccagc

SEQ ID NO: 10057530 - DNA, 22 bp, Homo sapiens
tgcagctgacccactccagtcc

SEQ ID NO: 10057531 - DNA, 22 bp, Homo sapiens
tgttttaatctcccattgctct

SEQ ID NO: 10057532 - DNA, 18 bp, Homo sapiens
tgtttatttttctcttac

SEQ ID NO: 10057533 - DNA, 18 bp, Homo sapiens
tgtttatttttctcttac

SEQ ID NO: 10057534 - DNA, 22 bp, Homo sapiens
tgtttgtggaatattctttaag

SEQ ID NO: 10057535 - DNA, 20 bp, Homo sapiens
tgtttgtgccagctttgtca

SEQ ID NO: 10057536 - DNA, 22 bp, Homo sapiens
ttaaacagacagtaaatgaaac

SEQ ID NO: 10057537 - DNA, 17 bp, Homo sapiens
tgttttttccctgttct

SEQ ID NO: 10057538 - DNA, 22 bp, Homo sapiens
tgtttttttatatacctgaagt

SEQ ID NO: 10057539 - DNA, 22 bp, Homo sapiens
ttaaaacagcgtgaatctggca

SEQ ID NO: 10057540 - DNA, 22 bp, Homo sapiens
ttaaaacagcgtgaatctggca

SEQ ID NO: 10057541 - DNA, 22 bp, Homo sapiens
tgttctttgccagtgatttaat

SEQ ID NO: 10057542 - DNA, 22 bp, Homo sapiens
tgttcttgagcctttagaccta

SEQ ID NO: 10057543 - DNA, 22 bp, Homo sapiens
tgttctttcagttagacacagt

SEQ ID NO: 10057544 - DNA, 22 bp, Homo sapiens
tgttacagtggctttttaaaca

SEQ ID NO: 10057545 - DNA, 22 bp, Homo sapiens
tgtttattttcaggatggattg

SEQ ID NO: 10057546 - DNA, 22 bp, Homo sapiens
tgtttattgctgcaattgtgcc

SEQ ID NO: 10057547 - DNA, 18 bp, Homo sapiens
tgtttattctcctgacag

SEQ ID NO: 10057548 - DNA, 22 bp, Homo sapiens
tgtttattgagtgcctactata

SEQ ID NO: 10057549 - DNA, 22 bp, Homo sapiens
tgtttattgcagtgctgggctg

SEQ ID NO: 10057550 - DNA, 22 bp, Homo sapiens
tgtttattacagttcttggaat

SEQ ID NO: 10057551 - DNA, 22 bp, Homo sapiens
tgtttattcatggctaatgaaa

SEQ ID NO: 10057552 - DNA, 22 bp, Homo sapiens
tgtttatgcatcgttaatacca

SEQ ID NO: 10057553 - DNA, 22 bp, Homo sapiens
tgtttatagatggccacaatga

SEQ ID NO: 10057554 - DNA, 22 bp, Homo sapiens
tgtttataccttggtataacca

SEQ ID NO: 10057555 - DNA, 22 bp, Homo sapiens
tgtttaaatagaacatactgca

SEQ ID NO: 10057556 - DNA, 22 bp, Homo sapiens
tgtgggattcatttggatcagc

SEQ ID NO: 10057557 - DNA, 22 bp, Homo sapiens
tgtgggcactaatgacatgcag

SEQ ID NO: 10057558 - DNA, 23 bp, Homo sapiens
tgtgtacatacatatgtacacac

SEQ ID NO: 10057559 - DNA, 22 bp, Homo sapiens
tgtgtacattgccttttaaagg

SEQ ID NO: 10057560 - DNA, 22 bp, Homo sapiens
tgtgtacacgagaggttatata

SEQ ID NO: 10057561 - DNA, 22 bp, Homo sapiens
tgtgtacaaactaacaacatat

SEQ ID NO: 10057562 - DNA, 22 bp, Homo sapiens
tgtggggactgagtggaggctt

SEQ ID NO: 10057563 - DNA, 22 bp, Homo sapiens
tgtggaagtgccaatgacaaat

SEQ ID NO: 10057564 - DNA, 22 bp, Homo sapiens
tgtggaaggggccccatgacca

SEQ ID NO: 10057565 - DNA, 22 bp, Homo sapiens
tgtgtggattcatctcaaagag

SEQ ID NO: 10057566 - DNA, 22 bp, Homo sapiens
tgtgtgggagcacgggctgttg

SEQ ID NO: 10057567 - DNA, 19 bp, Homo sapiens
tgtgtgctgactgccagag

SEQ ID NO: 10057568 - DNA, 22 bp, Homo sapiens
tgtgtgtgcacatgcatataca

SEQ ID NO: 10057569 - DNA, 22 bp, Homo sapiens
tgtgtgtgagtcctggctttcc

SEQ ID NO: 10057570 - DNA, 22 bp, Homo sapiens
tgtgtgtgaaccattgagggct

SEQ ID NO: 10057571 - DNA, 20 bp, Homo sapiens
tgtgtgtgtacttctaaata

SEQ ID NO: 10057572 - DNA, 23 bp, Homo sapiens
tgtgtgtgtattctacgcaaggt

SEQ ID NO: 10057573 - DNA, 22 bp, Homo sapiens
tgtgtgtgtgcgcgcacgcata

SEQ ID NO: 10057574 - DNA, 22 bp, Homo sapiens
tgtgtgtgggcggaacggcccc

SEQ ID NO: 10057575 - DNA, 22 bp, Homo sapiens
tgtgtgtgtaaaagcatttata

SEQ ID NO: 10057576 - DNA, 22 bp, Homo sapiens
tgtgttaagtatttgatacact

SEQ ID NO: 10057577 - DNA, 19 bp, Homo sapiens
tgtgtgtttatatatgtat

SEQ ID NO: 10057578 - DNA, 22 bp, Homo sapiens
tgtgtgtgttcctcctcagcta

SEQ ID NO: 10057579 - DNA, 22 bp, Homo sapiens
tgtgtgtgtttctgctcataca

SEQ ID NO: 10057580 - DNA, 22 bp, Homo sapiens
tgtgtgtgtttataaatctaaa

SEQ ID NO: 10057581 - DNA, 22 bp, Homo sapiens
tgtgtgttagtctcaaagccgt

SEQ ID NO: 10057582 - DNA, 22 bp, Homo sapiens
tgtctgggatgttggcagccac

SEQ ID NO: 10057583 - DNA, 18 bp, Homo sapiens
tgtctgcttctccaactc

SEQ ID NO: 10057584 - DNA, 22 bp, Homo sapiens
tgtctgtggcaattgtgggtaa

SEQ ID NO: 10057585 - DNA, 22 bp, Homo sapiens
tgtcttcaaatattgaaatcct

SEQ ID NO: 10057586 - DNA, 22 bp, Homo sapiens
tgtcttcgctacaatgaaaagg

SEQ ID NO: 10057587 - DNA, 22 bp, Homo sapiens
tgtctttaaaattaaacacatc

SEQ ID NO: 10057588 - DNA, 22 bp, Homo sapiens
tgtcttcatctcagacacagtt

SEQ ID NO: 10057589 - DNA, 22 bp, Homo sapiens
tgtcttcatgcctgaaagaaga

SEQ ID NO: 10057590 - DNA, 22 bp, Homo sapiens
tgtcttcatggcggaacaactt

SEQ ID NO: 10057591 - DNA, 22 bp, Homo sapiens
tgtctttaattctacatatctc

SEQ ID NO: 10057592 - DNA, 22 bp, Homo sapiens
tgtctttgttattgtggacagg

SEQ ID NO: 10057593 - DNA, 22 bp, Homo sapiens
tgtcttttggagcatctttctt

SEQ ID NO: 10057594 - DNA, 22 bp, Homo sapiens
tgtgaaaagcgtgtgttctagg

SEQ ID NO: 10057595 - DNA, 22 bp, Homo sapiens
tgtctccaaaacaatctcagat

SEQ ID NO: 10057596 - DNA, 22 bp, Homo sapiens
tgtctccaggggcaggccagcc

SEQ ID NO: 10057597 - DNA, 22 bp, Homo sapiens
tgtctacaaacgtgtacacatt

SEQ ID NO: 10057598 - DNA, 22 bp, Homo sapiens
tgtctaaatgaaaagagatgcc

SEQ ID NO: 10057599 - DNA, 22 bp, Homo sapiens
tgtctctgaggtgagggtcagc

SEQ ID NO: 10057600 - DNA, 22 bp, Homo sapiens
tgtctctgaaatatgtggctcc

SEQ ID NO: 10057601 - DNA, 22 bp, Homo sapiens
tgtctctgctttccttgcaggg

SEQ ID NO: 10057602 - DNA, 22 bp, Homo sapiens
tgtctgccattagcccagtcca

SEQ ID NO: 10057603 - DNA, 22 bp, Homo sapiens
tgtctgcaaagtccagcacagg

SEQ ID NO: 10057604 - DNA, 22 bp, Homo sapiens
tgtgattatattgtagtacatt

SEQ ID NO: 10057605 - DNA, 22 bp, Homo sapiens
tgtgagcaagattcagagattc

SEQ ID NO: 10057606 - DNA, 22 bp, Homo sapiens
tgtgagcactgtgatgctgttc

SEQ ID NO: 10057607 - DNA, 22 bp, Homo sapiens
tgtgacctcatcttaactggaa

SEQ ID NO: 10057608 - DNA, 22 bp, Homo sapiens
tgtgactaggcctgagctcttg

SEQ ID NO: 10057609 - DNA, 22 bp, Homo sapiens
tgtgactaggcctgagctcttg

SEQ ID NO: 10057610 - DNA, 22 bp, Homo sapiens
tgtgagacacactgctgcttca

SEQ ID NO: 10057611 - DNA, 22 bp, Homo sapiens
tgtgagacaggatttagagcag

SEQ ID NO: 10057612 - DNA, 23 bp, Homo sapiens
tgtgacagggtcattgaaaaggg

SEQ ID NO: 10057613 - DNA, 22 bp, Homo sapiens
tgtgacagaattggtctgttct

SEQ ID NO: 10057614 - DNA, 22 bp, Homo sapiens
tgtgacagatctttaaataatg

SEQ ID NO: 10057615 - DNA, 22 bp, Homo sapiens
tgtgaaatgctattgtgacaaa

SEQ ID NO: 10057616 - DNA, 22 bp, Homo sapiens
tgtgaaatgctattgtgacaaa

SEQ ID NO: 10057617 - DNA, 22 bp, Homo sapiens
tgtgaaaggagccatagacagt

SEQ ID NO: 10057618 - DNA, 22 bp, Homo sapiens
tgtgaaagcaagtctagttctc

SEQ ID NO: 10057619 - DNA, 22 bp, Homo sapiens
tgtgaaagagtcttatagtttc

SEQ ID NO: 10057620 - DNA, 22 bp, Homo sapiens
tgtgaaagatactaggcagagg

SEQ ID NO: 10057621 - DNA, 22 bp, Homo sapiens
tgtgccctcctgccaggggctg

SEQ ID NO: 10057622 - DNA, 22 bp, Homo sapiens
tgtgcctactgatagagccaag

SEQ ID NO: 10057623 - DNA, 22 bp, Homo sapiens
tgtggaaaattggaacgttcct

SEQ ID NO: 10057624 - DNA, 22 bp, Homo sapiens
tgtggaaagtcaagttccagga

SEQ ID NO: 10057625 - DNA, 22 bp, Homo sapiens
tgtgccttctcagtcctgctca

SEQ ID NO: 10057626 - DNA, 22 bp, Homo sapiens
ttcattgaaatgtttctagctg

SEQ ID NO: 10057627 - DNA, 22 bp, Homo sapiens
ttcattgaaatacagtcttgac

SEQ ID NO: 10057628 - DNA, 23 bp, Homo sapiens
ttccagaggaagaagtcatgact

SEQ ID NO: 10057629 - DNA, 23 bp, Homo sapiens
ttccagaggaagaagtcatgact

SEQ ID NO: 10057630 - DNA, 22 bp, Homo sapiens
ttccagaggagtgattcagagg

SEQ ID NO: 10057631 - DNA, 23 bp, Homo sapiens
ttcattgattgcaaggagattgg

SEQ ID NO: 10057632 - DNA, 22 bp, Homo sapiens
ttcattgatagttttatgtatg

SEQ ID NO: 10057633 - DNA, 21 bp, Homo sapiens
ttcattgaactatttgtggag

SEQ ID NO: 10057634 - DNA, 22 bp, Homo sapiens
ttcattgactggttcgttaagt

SEQ ID NO: 10057635 - DNA, 22 bp, Homo sapiens
ttcattgagctgtacacttagg

SEQ ID NO: 10057636 - DNA, 22 bp, Homo sapiens
ttccagagtgactgtgccactt

SEQ ID NO: 10057637 - DNA, 22 bp, Homo sapiens
ttccagagtctggttccatggt

SEQ ID NO: 10057638 - DNA, 22 bp, Homo sapiens
ttccagaggttctcagccctgt

SEQ ID NO: 10057639 - DNA, 23 bp, Homo sapiens
ttccagagtccacatctgccacc

SEQ ID NO: 10057640 - DNA, 22 bp, Homo sapiens
ttcaccctggaccagaaattgg

SEQ ID NO: 10057641 - DNA, 22 bp, Homo sapiens
ttcacccactagagaactcagg

SEQ ID NO: 10057642 - DNA, 22 bp, Homo sapiens
ttcagcagtgcagacacccagt

SEQ ID NO: 10057643 - DNA, 22 bp, Homo sapiens
ttcagcttgctgactgcggcag

SEQ ID NO: 10057644 - DNA, 22 bp, Homo sapiens
ttcagccagtcatcagtcttgt

SEQ ID NO: 10057645 - DNA, 22 bp, Homo sapiens
ttcagccaattagaagccccac

SEQ ID NO: 10057646 - DNA, 22 bp, Homo sapiens
ttagcagcttttaaatggttct

SEQ ID NO: 10057647 - DNA, 22 bp, Homo sapiens
ttagcagcttagactgcctggg

SEQ ID NO: 10057648 - DNA, 22 bp, Homo sapiens
ttagcagctaagtcatgctgca

SEQ ID NO: 10057649 - DNA, 22 bp, Homo sapiens
ttagcagcggtcagttttgaag

SEQ ID NO: 10057650 - DNA, 22 bp, Homo sapiens
ttagcagcatccctggcctgta

SEQ ID NO: 10057651 - DNA, 22 bp, Homo sapiens
ttagcagctaaactgacagacc

SEQ ID NO: 10057652 - DNA, 22 bp, Homo sapiens
ttagcagcggtcagttttgaag

SEQ ID NO: 10057653 - DNA, 22 bp, Homo sapiens
ttagcagcaatggcatcaacta

SEQ ID NO: 10057654 - DNA, 22 bp, Homo sapiens
ttaggaaattccacctgtattc

SEQ ID NO: 10057655 - DNA, 22 bp, Homo sapiens
ttagaaatcacctctgaagatc

SEQ ID NO: 10057656 - DNA, 22 bp, Homo sapiens
ttagaacagtagaagaaagggt

SEQ ID NO: 10057657 - DNA, 22 bp, Homo sapiens
ttagaacactgagaaagtgatg

SEQ ID NO: 10057658 - DNA, 22 bp, Homo sapiens
ttagaacatagcaacagaatta

SEQ ID NO: 10057659 - DNA, 22 bp, Homo sapiens
ttatgaaggatcaggtacttgg

SEQ ID NO: 10057660 - DNA, 22 bp, Homo sapiens
ttatgaaagacatttctgttgg

SEQ ID NO: 10057661 - DNA, 22 bp, Homo sapiens
ttatcttgagtattgagattct

SEQ ID NO: 10057662 - DNA, 22 bp, Homo sapiens
ttatcttggtgttttagtaatt

SEQ ID NO: 10057663 - DNA, 22 bp, Homo sapiens
ttatcttgtagagatattttcg

SEQ ID NO: 10057664 - DNA, 22 bp, Homo sapiens
ttattattccccaagtcattat

SEQ ID NO: 10057665 - DNA, 22 bp, Homo sapiens
ttagtgctaaatactcccacag

SEQ ID NO: 10057666 - DNA, 22 bp, Homo sapiens
ttattcagggataacatccagg

SEQ ID NO: 10057667 - DNA, 22 bp, Homo sapiens
ttaaagacatcacagattacac

SEQ ID NO: 10057668 - DNA, 22 bp, Homo sapiens
ttaaagaatagtgcccctattg

SEQ ID NO: 10057669 - DNA, 22 bp, Homo sapiens
ttaaagaggcaggttaaataat

SEQ ID NO: 10057670 - DNA, 22 bp, Homo sapiens
ttaatacagtctccagaagtaa

SEQ ID NO: 10057671 - DNA, 21 bp, Homo sapiens
ttaatgctatgcagaaaatct

SEQ ID NO: 10057672 - DNA, 22 bp, Homo sapiens
ttaatacaactgttgtcactgg

SEQ ID NO: 10057673 - DNA, 22 bp, Homo sapiens
ttaataaagtatgaattggaaa

SEQ ID NO: 10057674 - DNA, 22 bp, Homo sapiens
ttaataaagtatgaattggaaa

SEQ ID NO: 10057675 - DNA, 22 bp, Homo sapiens
ttaataacattgtgtatcaccc

SEQ ID NO: 10057676 - DNA, 22 bp, Homo sapiens
ttacaaagttctgagttcaaac

SEQ ID NO: 10057677 - DNA, 22 bp, Homo sapiens
ttaattaaattcatgagcattg

SEQ ID NO: 10057678 - DNA, 22 bp, Homo sapiens
ttaattaactagccaaccacta

SEQ ID NO: 10057679 - DNA, 22 bp, Homo sapiens
ttaattaagagatactgcagta

SEQ ID NO: 10057680 - DNA, 22 bp, Homo sapiens
ttacaacactacttatccttga

SEQ ID NO: 10057681 - DNA, 21 bp, Homo sapiens
ttacaacatttgtgttctatg

SEQ ID NO: 10057682 - DNA, 22 bp, Homo sapiens
ttacatttcccccttggaggct

SEQ ID NO: 10057683 - DNA, 22 bp, Homo sapiens
ttacattttagttaacctgtga

SEQ ID NO: 10057684 - DNA, 22 bp, Homo sapiens
ttacattagacccactttcatg

SEQ ID NO: 10057685 - DNA, 22 bp, Homo sapiens
ttacaattgagtctattgtatg

SEQ ID NO: 10057686 - DNA, 22 bp, Homo sapiens
ttacaatgcactcacctttaga

SEQ ID NO: 10057687 - DNA, 22 bp, Homo sapiens
ttacaagctaattgtttcagct

SEQ ID NO: 10057688 - DNA, 22 bp, Homo sapiens
ttacaagattaattattggagt

SEQ ID NO: 10057689 - DNA, 22 bp, Homo sapiens
ttacagaatgttcttccaacag

SEQ ID NO: 10057690 - DNA, 22 bp, Homo sapiens
ttacagagaggtgattgtgaag

SEQ ID NO: 10057691 - DNA, 22 bp, Homo sapiens
ttacagagcctcattttagaga

SEQ ID NO: 10057692 - DNA, 22 bp, Homo sapiens
ttacagagctcatttctaaggg

SEQ ID NO: 10057693 - DNA, 22 bp, Homo sapiens
ttacagagtggtctggctatgt

SEQ ID NO: 10057694 - DNA, 22 bp, Homo sapiens
ttacagagtagggaattgaagt

SEQ ID NO: 10057695 - DNA, 22 bp, Homo sapiens
tgggtggtccaggctcagcaga

SEQ ID NO: 10057696 - DNA, 22 bp, Homo sapiens
tgggtggtcttgcttcccagga

SEQ ID NO: 10057697 - DNA, 22 bp, Homo sapiens
tgggtggtccaggctcagcaga

SEQ ID NO: 10057698 - DNA, 22 bp, Homo sapiens
tgggtgtccagaccctgcacat

SEQ ID NO: 10057699 - DNA, 22 bp, Homo sapiens
tgggttaacagtttataccaga

SEQ ID NO: 10057700 - DNA, 22 bp, Homo sapiens
tgggtgaggatgatgaggcagc

SEQ ID NO: 10057701 - DNA, 22 bp, Homo sapiens
tggtatgtaaattgtaactcaa

SEQ ID NO: 10057702 - DNA, 22 bp, Homo sapiens
tggtatggctaacgaggtcaag

SEQ ID NO: 10057703 - DNA, 22 bp, Homo sapiens
tggtatgaccgtggtgcaagca

SEQ ID NO: 10057704 - DNA, 20 bp, Homo sapiens
tgggtctgcttggcttcagt

SEQ ID NO: 10057705 - DNA, 22 bp, Homo sapiens
tgggtctgtagggctgtccaat

SEQ ID NO: 10057706 - DNA, 22 bp, Homo sapiens
tgggtctcctgtgcctgggagg

SEQ ID NO: 10057707 - DNA, 23 bp, Homo sapiens
tgggtctctagtacaggcaggca

SEQ ID NO: 10057708 - DNA, 22 bp, Homo sapiens
tgggtctccagttcagggcagg

SEQ ID NO: 10057709 - DNA, 22 bp, Homo sapiens
tgggtagaaacaaggctggact

SEQ ID NO: 10057710 - DNA, 22 bp, Homo sapiens
tggggctcctcctggcaggagg

SEQ ID NO: 10057711 - DNA, 22 bp, Homo sapiens
tgggggcacttcgaggtcgcct

SEQ ID NO: 10057712 - DNA, 22 bp, Homo sapiens
tgggggcatggaccagcctggc

SEQ ID NO: 10057713 - DNA, 22 bp, Homo sapiens
tggggctggctattgtctccct

SEQ ID NO: 10057714 - DNA, 22 bp, Homo sapiens
tggggctggggatcttgagcct

SEQ ID NO: 10057715 - DNA, 22 bp, Homo sapiens
tgggggagagtgcaagcatgaa

SEQ ID NO: 10057716 - DNA, 22 bp, Homo sapiens
tgggggagattgtgcatctcta

SEQ ID NO: 10057717 - DNA, 22 bp, Homo sapiens
tgggggagattagagcttctta

SEQ ID NO: 10057718 - DNA, 22 bp, Homo sapiens
tggggaaaggagagcattattt

SEQ ID NO: 10057719 - DNA, 22 bp, Homo sapiens
tggggaaagacattcatacagt

SEQ ID NO: 10057720 - DNA, 17 bp, Homo sapiens
tggggatggttcatgag

SEQ ID NO: 10057721 - DNA, 22 bp, Homo sapiens
tggggatgtaaatgaggtgata

SEQ ID NO: 10057722 - DNA, 22 bp, Homo sapiens
tggggacatagccagtctggct

SEQ ID NO: 10057723 - DNA, 22 bp, Homo sapiens
tgggccaggcatgtgatcagca

SEQ ID NO: 10057724 - DNA, 22 bp, Homo sapiens
tgggccagggcacccagtccag

SEQ ID NO: 10057725 - DNA, 18 bp, Homo sapiens
tgggcctgcatcctagtc

SEQ ID NO: 10057726 - DNA, 22 bp, Homo sapiens
tgggctattaggaccaggccat

SEQ ID NO: 10057727 - DNA, 22 bp, Homo sapiens
tgggcagggagctggaaccaca

SEQ ID NO: 10057728 - DNA, 22 bp, Homo sapiens
tgggcagggagctggaaccaca

SEQ ID NO: 10057729 - DNA, 21 bp, Homo sapiens
tgggcagatggcagtgtggct

SEQ ID NO: 10057730 - DNA, 22 bp, Homo sapiens
tgggcagattaatgcagtggct

SEQ ID NO: 10057731 - DNA, 22 bp, Homo sapiens
tgggcagatctttggtggctag

SEQ ID NO: 10057732 - DNA, 20 bp, Homo sapiens
tgggcagcactgctggctgg

SEQ ID NO: 10057733 - DNA, 22 bp, Homo sapiens
tgggcagcaaagactgtgtgct

SEQ ID NO: 10057734 - DNA, 22 bp, Homo sapiens
tgggccaggatttcaagaccct

SEQ ID NO: 10057735 - DNA, 23 bp, Homo sapiens
tgggatggattcaccagtgtgct

SEQ ID NO: 10057736 - DNA, 22 bp, Homo sapiens
tgggatgccggcaggaggcaat

SEQ ID NO: 10057737 - DNA, 22 bp, Homo sapiens
tgggagtccattgtcccaggca

SEQ ID NO: 10057738 - DNA, 22 bp, Homo sapiens
tgggagtcagtcgttctcagag

SEQ ID NO: 10057739 - DNA, 22 bp, Homo sapiens
tgggagtcaaccctcacgagca

SEQ ID NO: 10057740 - DNA, 22 bp, Homo sapiens
tgggcactatggctctgtgcac

SEQ ID NO: 10057741 - DNA, 22 bp, Homo sapiens
tgggatgggatctcgctgtgtc

SEQ ID NO: 10057742 - DNA, 22 bp, Homo sapiens
tgggcaaaggctgtaacccatc

SEQ ID NO: 10057743 - DNA, 22 bp, Homo sapiens
tgggcaaactgtcaaccatgtc

SEQ ID NO: 10057744 - DNA, 22 bp, Homo sapiens
tgggcaaagtcacatacatgat

SEQ ID NO: 10057745 - DNA, 22 bp, Homo sapiens
tgggcaaatgctttttagtcaa

SEQ ID NO: 10057746 - DNA, 22 bp, Homo sapiens
tgtcacagatcgtttttgagct

SEQ ID NO: 10057747 - DNA, 22 bp, Homo sapiens
tgtcacatgaaacttgctcatc

SEQ ID NO: 10057748 - DNA, 22 bp, Homo sapiens
tgtcaccaccggaagaaactgc

SEQ ID NO: 10057749 - DNA, 22 bp, Homo sapiens
tgtcaccaccggaagaaactgc

SEQ ID NO: 10057750 - DNA, 22 bp, Homo sapiens
tgtcaccatgccagcttctgcc

SEQ ID NO: 10057751 - DNA, 22 bp, Homo sapiens
tgtatttttagacctttagacc

SEQ ID NO: 10057752 - DNA, 22 bp, Homo sapiens
tgtatttaagctttacctaaaa

SEQ ID NO: 10057753 - DNA, 22 bp, Homo sapiens
tgtattttctgaggagcattag

SEQ ID NO: 10057754 - DNA, 22 bp, Homo sapiens
tgtataaatttaaattcctgct

SEQ ID NO: 10057755 - DNA, 22 bp, Homo sapiens
tgtataaatttaaattcctgct

SEQ ID NO: 10057756 - DNA, 22 bp, Homo sapiens
tgtatcatatggggaagcttca

SEQ ID NO: 10057757 - DNA, 22 bp, Homo sapiens
tgtatcagatcaaatactggct

SEQ ID NO: 10057758 - DNA, 22 bp, Homo sapiens
tgtatctttctgtacttttatg

SEQ ID NO: 10057759 - DNA, 22 bp, Homo sapiens
tgtatcttcagtttgtctttcc

SEQ ID NO: 10057760 - DNA, 22 bp, Homo sapiens
tgtatattcactgagcaagggg

SEQ ID NO: 10057761 - DNA, 22 bp, Homo sapiens
tgtatattctgcctaaaagctt

SEQ ID NO: 10057762 - DNA, 22 bp, Homo sapiens
tgtagaaagaatatgtttcata

SEQ ID NO: 10057763 - DNA, 22 bp, Homo sapiens
tgtagaaattagtaagatcaac

SEQ ID NO: 10057764 - DNA, 22 bp, Homo sapiens
tgtagctatagaggctgtacct

SEQ ID NO: 10057765 - DNA, 18 bp, Homo sapiens
tgtagctggaggccaggc

SEQ ID NO: 10057766 - DNA, 22 bp, Homo sapiens
tgtccctggactccaggagcca

SEQ ID NO: 10057767 - DNA, 22 bp, Homo sapiens
tgtccccaggtcctctgccgtc

SEQ ID NO: 10057768 - DNA, 22 bp, Homo sapiens
tgtccaggtggcctctgctgct

SEQ ID NO: 10057769 - DNA, 22 bp, Homo sapiens
tgtccttcttgtcttgcccaaa

SEQ ID NO: 10057770 - DNA, 22 bp, Homo sapiens
tgtccactttgtcagtgtcata

SEQ ID NO: 10057771 - DNA, 21 bp, Homo sapiens
tgtccaaggtatgcactgggg

SEQ ID NO: 10057772 - DNA, 22 bp, Homo sapiens
tgtcatcatttgagagaagaaa

SEQ ID NO: 10057773 - DNA, 22 bp, Homo sapiens
tgtcatcaactcacagagccaa

SEQ ID NO: 10057774 - DNA, 22 bp, Homo sapiens
tgtcatcagcatataagacagt

SEQ ID NO: 10057775 - DNA, 22 bp, Homo sapiens
tgtcagttcagtgattacaaaa

SEQ ID NO: 10057776 - DNA, 22 bp, Homo sapiens
tgtcagtttagttgaagaaaga

SEQ ID NO: 10057777 - DNA, 21 bp, Homo sapiens
tgtcagaaataagcatgtgat

SEQ ID NO: 10057778 - DNA, 22 bp, Homo sapiens
tgtcactgtgctctgttcattt

SEQ ID NO: 10057779 - DNA, 22 bp, Homo sapiens
tgtacacaacgtgcaggtttgt

SEQ ID NO: 10057780 - DNA, 22 bp, Homo sapiens
tgtacacaatgtgcaggtttgt

SEQ ID NO: 10057781 - DNA, 22 bp, Homo sapiens
tgtacagactgtatttacaagt

SEQ ID NO: 10057782 - DNA, 22 bp, Homo sapiens
tgtacagaggtgtacatatgat

SEQ ID NO: 10057783 - DNA, 22 bp, Homo sapiens
tgtacagtctgcagcttgctgt

SEQ ID NO: 10057784 - DNA, 22 bp, Homo sapiens
tgtacagtgccatgcagtttgc

SEQ ID NO: 10057785 - DNA, 22 bp, Homo sapiens
tgtacagtatatttcaaagcca

SEQ ID NO: 10057786 - DNA, 22 bp, Homo sapiens
tgtaacagttataacaatgtgg

SEQ ID NO: 10057787 - DNA, 22 bp, Homo sapiens
tgtaacagtagttactattctt

SEQ ID NO: 10057788 - DNA, 22 bp, Homo sapiens
tgtaacagtagataaggtcttg

SEQ ID NO: 10057789 - DNA, 22 bp, Homo sapiens
tgtaagaaaacctgtacaaaga

SEQ ID NO: 10057790 - DNA, 22 bp, Homo sapiens
tgtaaaggtaggtgcaaaatga

SEQ ID NO: 10057791 - DNA, 22 bp, Homo sapiens
tgtaaagggtgttaaattactc

SEQ ID NO: 10057792 - DNA, 22 bp, Homo sapiens
tgtaaagatccttagcaacatc

SEQ ID NO: 10057793 - DNA, 18 bp, Homo sapiens
tgtaaacactttcattct

SEQ ID NO: 10057794 - DNA, 22 bp, Homo sapiens
tgtaaagagaaggcttataaag

SEQ ID NO: 10057795 - DNA, 22 bp, Homo sapiens
tgtaaagagaagaaacgtgagc

SEQ ID NO: 10057796 - DNA, 22 bp, Homo sapiens
tggtttgtatatgtttgtgaga

SEQ ID NO: 10057797 - DNA, 18 bp, Homo sapiens
tggtttgtcatgagaatt

SEQ ID NO: 10057798 - DNA, 22 bp, Homo sapiens
tgtaaaaccaaatcaatctagt

SEQ ID NO: 10057799 - DNA, 22 bp, Homo sapiens
tgtaaaaagcccagccgctgag

SEQ ID NO: 10057800 - DNA, 22 bp, Homo sapiens
tgtaaaaggaaatcaaagcact

SEQ ID NO: 10057801 - DNA, 22 bp, Homo sapiens
tggtggtctggctttatatcct

SEQ ID NO: 10057802 - DNA, 22 bp, Homo sapiens
tggtgtaatcagtttctagctc

SEQ ID NO: 10057803 - DNA, 23 bp, Homo sapiens
tggtggggtcttggagacagcac

SEQ ID NO: 10057804 - DNA, 23 bp, Homo sapiens
tggtggggtcttggagacagcac

SEQ ID NO: 10057805 - DNA, 22 bp, Homo sapiens
tggtgtctggcacacaggaagc

SEQ ID NO: 10057806 - DNA, 22 bp, Homo sapiens
tggtgtcttggaagtaggtgct

SEQ ID NO: 10057807 - DNA, 22 bp, Homo sapiens
tggtgtgggcagcagcaggtac

SEQ ID NO: 10057808 - DNA, 22 bp, Homo sapiens
tggtgtgggcgtggcaggcaag

SEQ ID NO: 10057809 - DNA, 22 bp, Homo sapiens
tggtgtgggcgtggcaggcaag

SEQ ID NO: 10057810 - DNA, 22 bp, Homo sapiens
tggtgtgggcgtggcaggcaag

SEQ ID NO: 10057811 - DNA, 22 bp, Homo sapiens
tggtgtggggataagcactctg

SEQ ID NO: 10057812 - DNA, 22 bp, Homo sapiens
tggtgtggtccagtgacatact

SEQ ID NO: 10057813 - DNA, 22 bp, Homo sapiens
tggttgtggtcctccacatcgc

SEQ ID NO: 10057814 - DNA, 22 bp, Homo sapiens
tggttcctcaagcgctggcggc

SEQ ID NO: 10057815 - DNA, 22 bp, Homo sapiens
tggttgtgagcgatggatggag

SEQ ID NO: 10057816 - DNA, 22 bp, Homo sapiens
tggttggctgagcagagtcact

SEQ ID NO: 10057817 - DNA, 22 bp, Homo sapiens
tggttggggtctgcagccatcc

SEQ ID NO: 10057818 - DNA, 22 bp, Homo sapiens
tggtcgggagcgagcagctatt

SEQ ID NO: 10057819 - DNA, 22 bp, Homo sapiens
tggtgagctctggcagtctgtg

SEQ ID NO: 10057820 - DNA, 22 bp, Homo sapiens
tggtcctgcccacgcccatctg

SEQ ID NO: 10057821 - DNA, 22 bp, Homo sapiens
tggtggcaaatcaggacacttc

SEQ ID NO: 10057822 - DNA, 22 bp, Homo sapiens
tggtggcaacattgctggagtg

SEQ ID NO: 10057823 - DNA, 22 bp, Homo sapiens
tggtggcaaagtacaaagtgac

SEQ ID NO: 10057824 - DNA, 20 bp, Homo sapiens
tggtggactttggcatggct

SEQ ID NO: 10057825 - DNA, 22 bp, Homo sapiens
tggtgggagtgagggcatgcca

SEQ ID NO: 10057826 - DNA, 16 bp, Homo sapiens
tggtggggaggacagc

SEQ ID NO: 10057827 - DNA, 22 bp, Homo sapiens
tggtggggattccctccctggc

SEQ ID NO: 10057828 - DNA, 22 bp, Homo sapiens
tggtggggtcatcgtcagatgc

SEQ ID NO: 10057829 - DNA, 22 bp, Homo sapiens
tggtgggggaggctgtctagca

SEQ ID NO: 10057830 - DNA, 22 bp, Homo sapiens
tggtggggccagacttcagctc

SEQ ID NO: 10057831 - DNA, 22 bp, Homo sapiens
tggtggggctttccttctgctt

SEQ ID NO: 10057832 - DNA, 22 bp, Homo sapiens
tggtggggattccctccctggc

SEQ ID NO: 10057833 - DNA, 22 bp, Homo sapiens
tggtggggccagacttcagctc

SEQ ID NO: 10057834 - DNA, 22 bp, Homo sapiens
tggtggcatgatagtgtgaatg

SEQ ID NO: 10057835 - DNA, 22 bp, Homo sapiens
tggtggcagtctcctggctgtg

SEQ ID NO: 10057836 - DNA, 22 bp, Homo sapiens
tggtggcagctgggacagaggt

SEQ ID NO: 10057837 - DNA, 22 bp, Homo sapiens
tggtggcagagcaagagctgga

SEQ ID NO: 10057838 - DNA, 23 bp, Homo sapiens
tggtggcagaagtagcagatgac

SEQ ID NO: 10057839 - DNA, 22 bp, Homo sapiens
tggtggcagagcaagagctgga

SEQ ID NO: 10057840 - DNA, 23 bp, Homo sapiens
tggtggcagaagtagcagatgac

SEQ ID NO: 10057841 - DNA, 22 bp, Homo sapiens
tggtggcaatgtcctggagaag

SEQ ID NO: 10057842 - DNA, 22 bp, Homo sapiens
tggagcagctaagcctctgaga

SEQ ID NO: 10057843 - DNA, 22 bp, Homo sapiens
tggagcagctgaacagagttga

SEQ ID NO: 10057844 - DNA, 22 bp, Homo sapiens
tggagcaggtgctcagggtaat

SEQ ID NO: 10057845 - DNA, 22 bp, Homo sapiens
tggagcaggtgccaggtgtgtg

SEQ ID NO: 10057846 - DNA, 22 bp, Homo sapiens
tggagcaggacggggagtggta

SEQ ID NO: 10057847 - DNA, 21 bp, Homo sapiens
tggagctgaatttttggcatc

SEQ ID NO: 10057848 - DNA, 18 bp, Homo sapiens
tggagctgagtgctgtgc

SEQ ID NO: 10057849 - DNA, 23 bp, Homo sapiens
tggagctgacagtcagagggagg

SEQ ID NO: 10057850 - DNA, 22 bp, Homo sapiens
tggagctgaactttgaggccag

SEQ ID NO: 10057851 - DNA, 22 bp, Homo sapiens
tggagctggaatttctgggcct

SEQ ID NO: 10057852 - DNA, 22 bp, Homo sapiens
tggagctggcagcggaaaaggg

SEQ ID NO: 10057853 - DNA, 22 bp, Homo sapiens
tggagctggcttgtggaagttg

SEQ ID NO: 10057854 - DNA, 22 bp, Homo sapiens
tggagctgatacagctggcttt

SEQ ID NO: 10057855 - DNA, 21 bp, Homo sapiens
tggagctgccacttgtcctcc

SEQ ID NO: 10057856 - DNA, 22 bp, Homo sapiens
tggagaggagcaccatggccat

SEQ ID NO: 10057857 - DNA, 22 bp, Homo sapiens
tggagaggagcaccatggccat

SEQ ID NO: 10057858 - DNA, 22 bp, Homo sapiens
tggagcagaaatttgaagccat

SEQ ID NO: 10057859 - DNA, 22 bp, Homo sapiens
tggagcagccatgatgacagag

SEQ ID NO: 10057860 - DNA, 22 bp, Homo sapiens
tggagcagagttcagcggggag

SEQ ID NO: 10057861 - DNA, 22 bp, Homo sapiens
tggagcagaggctgaggttggg

SEQ ID NO: 10057862 - DNA, 22 bp, Homo sapiens
tggagcagagatggtggccttc

SEQ ID NO: 10057863 - DNA, 22 bp, Homo sapiens
tggagaagctgtaggtggactc

SEQ ID NO: 10057864 - DNA, 22 bp, Homo sapiens
tggagctggtaaacagtgacat

SEQ ID NO: 10057865 - DNA, 23 bp, Homo sapiens
tggagctgggcagctgggaaagt

SEQ ID NO: 10057866 - DNA, 22 bp, Homo sapiens
tggagctgtcactcagaaccaa

SEQ ID NO: 10057867 - DNA, 22 bp, Homo sapiens
tggagctggttctggggaagct

SEQ ID NO: 10057868 - DNA, 23 bp, Homo sapiens
tggaggttttactgagttgagga

SEQ ID NO: 10057869 - DNA, 22 bp, Homo sapiens
tggaggtgtggagtcaaaggga

SEQ ID NO: 10057870 - DNA, 22 bp, Homo sapiens
tggataaatggtgctatcaccc

SEQ ID NO: 10057871 - DNA, 22 bp, Homo sapiens
tggaggtggcacaagggaggtc

SEQ ID NO: 10057872 - DNA, 22 bp, Homo sapiens
tggaaaatcaggggacattgat

SEQ ID NO: 10057873 - DNA, 21 bp, Homo sapiens
tggaaaaatgtggcctagtga

SEQ ID NO: 10057874 - DNA, 22 bp, Homo sapiens
tggaaaaaaattggctagcttc

SEQ ID NO: 10057875 - DNA, 22 bp, Homo sapiens
tgcttttaggagattaaaatta

SEQ ID NO: 10057876 - DNA, 22 bp, Homo sapiens
tgctttggccactagaattcag

SEQ ID NO: 10057877 - DNA, 22 bp, Homo sapiens
tgctttgggtttgactctcatg

SEQ ID NO: 10057878 - DNA, 22 bp, Homo sapiens
tgctttgtgtttgaatagataa

SEQ ID NO: 10057879 - DNA, 22 bp, Homo sapiens
tgctttgtgtacacaagaatca

SEQ ID NO: 10057880 - DNA, 22 bp, Homo sapiens
tgcttttaggagattaaaatta

SEQ ID NO: 10057881 - DNA, 22 bp, Homo sapiens
tggaaagcgaggagttggcatt

SEQ ID NO: 10057882 - DNA, 21 bp, Homo sapiens
tggaactggtgaaaacctcct

SEQ ID NO: 10057883 - DNA, 22 bp, Homo sapiens
tggaactgctccaaaacctcca

SEQ ID NO: 10057884 - DNA, 22 bp, Homo sapiens
tggaaatggatctgatgagtct

SEQ ID NO: 10057885 - DNA, 22 bp, Homo sapiens
tggaaatgtttcttgagctcag

SEQ ID NO: 10057886 - DNA, 22 bp, Homo sapiens
tgctttaaaatggactgttttg

SEQ ID NO: 10057887 - DNA, 22 bp, Homo sapiens
tgctttaaaccatggatgtgag

SEQ ID NO: 10057888 - DNA, 22 bp, Homo sapiens
tgctttaagacactaagtttga

SEQ ID NO: 10057889 - DNA, 22 bp, Homo sapiens
tgctttaaccatcttgtttgga

SEQ ID NO: 10057890 - DNA, 22 bp, Homo sapiens
tgctttaacataagatatcttt

SEQ ID NO: 10057891 - DNA, 22 bp, Homo sapiens
tgctttaagagattgttagtac

SEQ ID NO: 10057892 - DNA, 22 bp, Homo sapiens
tgctttagttcaacatgccaaa

SEQ ID NO: 10057893 - DNA, 20 bp, Homo sapiens
tgctttgatggaaatacagc

SEQ ID NO: 10057894 - DNA, 22 bp, Homo sapiens
tgctttgaaagataatactgtc

SEQ ID NO: 10057895 - DNA, 22 bp, Homo sapiens
tgctttgacagggatgacatga

SEQ ID NO: 10057896 - DNA, 22 bp, Homo sapiens
tgctttattcagggtttacccc

SEQ ID NO: 10057897 - DNA, 22 bp, Homo sapiens
tgctttataaccatttctgtgg

SEQ ID NO: 10057898 - DNA, 22 bp, Homo sapiens
tgctttataacttagtttatgg

SEQ ID NO: 10057899 - DNA, 22 bp, Homo sapiens
tgctttatagacaaggaagtag

SEQ ID NO: 10057900 - DNA, 22 bp, Homo sapiens
tgctttatcaaagctatagtga

SEQ ID NO: 10057901 - DNA, 22 bp, Homo sapiens
tgctttatatctctcttcttag

SEQ ID NO: 10057902 - DNA, 22 bp, Homo sapiens
tgctttatgtggctgatactca

SEQ ID NO: 10057903 - DNA, 21 bp, Homo sapiens
tgctttatgggaaaaatgtca

SEQ ID NO: 10057904 - DNA, 18 bp, Homo sapiens
tgctttatgcttatataa

SEQ ID NO: 10057905 - DNA, 22 bp, Homo sapiens
tggaagcagagagctatcacca

SEQ ID NO: 10057906 - DNA, 22 bp, Homo sapiens
tggaagcagtgattcttgtctg

SEQ ID NO: 10057907 - DNA, 22 bp, Homo sapiens
tggaagcaaaatatcctttaat

SEQ ID NO: 10057908 - DNA, 22 bp, Homo sapiens
tggaagggggaagacagctctg

SEQ ID NO: 10057909 - DNA, 22 bp, Homo sapiens
tggacaaatgatttctaccttt

SEQ ID NO: 10057910 - DNA, 22 bp, Homo sapiens
tggacaggatagtgcagtacgc

SEQ ID NO: 10057911 - DNA, 22 bp, Homo sapiens
tggacaggtgagtgactcaggg

SEQ ID NO: 10057912 - DNA, 22 bp, Homo sapiens
tggacaggtgagtgactcaggg

SEQ ID NO: 10057913 - DNA, 22 bp, Homo sapiens
tggacagggcagagaccgagtc

SEQ ID NO: 10057914 - DNA, 22 bp, Homo sapiens
tggacagggcagagaccgagtc

SEQ ID NO: 10057915 - DNA, 18 bp, Homo sapiens
tggacagggtggagaaaa

SEQ ID NO: 10057916 - DNA, 23 bp, Homo sapiens
tggacagggtaactggtggtttt

SEQ ID NO: 10057917 - DNA, 22 bp, Homo sapiens
tggactgggctaatggcagaca

SEQ ID NO: 10057918 - DNA, 22 bp, Homo sapiens
tggactggaatgctgatcctct

SEQ ID NO: 10057919 - DNA, 22 bp, Homo sapiens
tggactggaatgctgatcctct

SEQ ID NO: 10057920 - DNA, 19 bp, Homo sapiens
tgctatttagaacgcctgg

SEQ ID NO: 10057921 - DNA, 22 bp, Homo sapiens
tgctatttggaaaagcatttgg

SEQ ID NO: 10057922 - DNA, 22 bp, Homo sapiens
tgctattttggtctacagcact

SEQ ID NO: 10057923 - DNA, 22 bp, Homo sapiens
tgcgtggcgcagcgtgtgggat

SEQ ID NO: 10057924 - DNA, 22 bp, Homo sapiens
tgcgtggctgcgaggacccagc

SEQ ID NO: 10057925 - DNA, 22 bp, Homo sapiens
tgcggcagccaccgcgtggccc

SEQ ID NO: 10057926 - DNA, 22 bp, Homo sapiens
tgcggcaggagaaggtgttatg

SEQ ID NO: 10057927 - DNA, 22 bp, Homo sapiens
tgctcagctggtgccagggtcc

SEQ ID NO: 10057928 - DNA, 22 bp, Homo sapiens
tgctcagcacagaccaggccag

SEQ ID NO: 10057929 - DNA, 22 bp, Homo sapiens
tgctcactctattcacagtgcc

SEQ ID NO: 10057930 - DNA, 22 bp, Homo sapiens
tgctcacaattatcagaagtat

SEQ ID NO: 10057931 - DNA, 22 bp, Homo sapiens
tgctcaatgtcttatgagactg

SEQ ID NO: 10057932 - DNA, 22 bp, Homo sapiens
tgcctggggattgctctgggcc

SEQ ID NO: 10057933 - DNA, 22 bp, Homo sapiens
tgcctgggtccaggccaagcct

SEQ ID NO: 10057934 - DNA, 21 bp, Homo sapiens
tgcctggcctttgcttttcct

SEQ ID NO: 10057935 - DNA, 22 bp, Homo sapiens
tgcctgggtgtaaagggccaac

SEQ ID NO: 10057936 - DNA, 22 bp, Homo sapiens
tgcctgtgacccaaggatgcga

SEQ ID NO: 10057937 - DNA, 22 bp, Homo sapiens
tgcctttaacttaaagcatgac

SEQ ID NO: 10057938 - DNA, 17 bp, Homo sapiens
tgctcctgtggcagcct

SEQ ID NO: 10057939 - DNA, 22 bp, Homo sapiens
tgctcctgtttcatcagctata

SEQ ID NO: 10057940 - DNA, 22 bp, Homo sapiens
tgctcctgggctgaagcacact

SEQ ID NO: 10057941 - DNA, 21 bp, Homo sapiens
tgctcctttaccccacaagac

SEQ ID NO: 10057942 - DNA, 22 bp, Homo sapiens
tgctccttcccttcccagtgag

SEQ ID NO: 10057943 - DNA, 22 bp, Homo sapiens
tgctctgggctcaatggcagct

SEQ ID NO: 10057944 - DNA, 22 bp, Homo sapiens
tgctctggggagctcctctgcg

SEQ ID NO: 10057945 - DNA, 22 bp, Homo sapiens
tgctctggctgggatgagtgca

SEQ ID NO: 10057946 - DNA, 23 bp, Homo sapiens
tgctctgggaggccctggagagc

SEQ ID NO: 10057947 - DNA, 22 bp, Homo sapiens
tgctcccaggctctgtggtctg

SEQ ID NO: 10057948 - DNA, 22 bp, Homo sapiens
tgctccctgctcagagaggcca

SEQ ID NO: 10057949 - DNA, 22 bp, Homo sapiens
tgctcctgctgcatgcatctcc

SEQ ID NO: 10057950 - DNA, 22 bp, Homo sapiens
tgctcctgagcggtttccatga

SEQ ID NO: 10057951 - DNA, 22 bp, Homo sapiens
tgctctgggggaagccagctgt

SEQ ID NO: 10057952 - DNA, 20 bp, Homo sapiens
tgctctgggggtggagagac

SEQ ID NO: 10057953 - DNA, 18 bp, Homo sapiens
tgctctggtctcacttgg

SEQ ID NO: 10057954 - DNA, 22 bp, Homo sapiens
tgctctggtaactcacttccat

SEQ ID NO: 10057955 - DNA, 22 bp, Homo sapiens
tgctcttcaccattacatcatg

SEQ ID NO: 10057956 - DNA, 22 bp, Homo sapiens
tgctcttcacagtttcagcatc

SEQ ID NO: 10057957 - DNA, 22 bp, Homo sapiens
tgctgagcgcatccggcggccg

SEQ ID NO: 10057958 - DNA, 22 bp, Homo sapiens
tgctgcagttcaccctgccgtc

SEQ ID NO: 10057959 - DNA, 22 bp, Homo sapiens
tgctgtcttttcccaatcctgg

SEQ ID NO: 10057960 - DNA, 22 bp, Homo sapiens
tgctgtccctaagtctcttcaa

SEQ ID NO: 10057961 - DNA, 22 bp, Homo sapiens
tgctgtcctgctgagggatgtg

SEQ ID NO: 10057962 - DNA, 22 bp, Homo sapiens
tgcttaaacacatacatacata

SEQ ID NO: 10057963 - DNA, 22 bp, Homo sapiens
tgcttaaacatccagacagtat

SEQ ID NO: 10057964 - DNA, 22 bp, Homo sapiens
tgcttaatgtacgtgagtgtac

SEQ ID NO: 10057965 - DNA, 22 bp, Homo sapiens
tgcttaatagtgcactggtttc

SEQ ID NO: 10057966 - DNA, 22 bp, Homo sapiens
tgcttatttaggtagatattaa

SEQ ID NO: 10057967 - DNA, 22 bp, Homo sapiens
tgcttatttgaatttattctca

SEQ ID NO: 10057968 - DNA, 22 bp, Homo sapiens
tgcttatcgtttagtacattgc

SEQ ID NO: 10057969 - DNA, 22 bp, Homo sapiens
tgcttattaaacatgcatattc

SEQ ID NO: 10057970 - DNA, 22 bp, Homo sapiens
tgcttattaacatgtatatctc

SEQ ID NO: 10057971 - DNA, 23 bp, Homo sapiens
tgcttattcaaaaggtgctttca

SEQ ID NO: 10057972 - DNA, 22 bp, Homo sapiens
tgcttcagcactttgagagcct

SEQ ID NO: 10057973 - DNA, 22 bp, Homo sapiens
tgcttcagtcctatgggcaggt

SEQ ID NO: 10057974 - DNA, 20 bp, Homo sapiens
tgcttcattatgtgagatag

SEQ ID NO: 10057975 - DNA, 22 bp, Homo sapiens
tgctggcttggaaggaaagcgc

SEQ ID NO: 10057976 - DNA, 22 bp, Homo sapiens
tgctggcttcctgtgcacagca

SEQ ID NO: 10057977 - DNA, 22 bp, Homo sapiens
tgctgggctgttcctgtccatg

SEQ ID NO: 10057978 - DNA, 22 bp, Homo sapiens
tgctggggcagaagagccaaga

SEQ ID NO: 10057979 - DNA, 20 bp, Homo sapiens
tgctggggacatacagggtg

SEQ ID NO: 10057980 - DNA, 23 bp, Homo sapiens
tgctggggtagtttgtggcacag

SEQ ID NO: 10057981 - DNA, 23 bp, Homo sapiens
tgctggggtagtttgtggcacag

SEQ ID NO: 10057982 - DNA, 22 bp, Homo sapiens
tgctggggtcatggggcgcccg

SEQ ID NO: 10057983 - DNA, 22 bp, Homo sapiens
tgctggggtctctccggtgccc

SEQ ID NO: 10057984 - DNA, 22 bp, Homo sapiens
tgctggggtctctccggtgccc

SEQ ID NO: 10057985 - DNA, 23 bp, Homo sapiens
tgctggtgtttttgggaccaggg

SEQ ID NO: 10057986 - DNA, 23 bp, Homo sapiens
tgctgtccaacagactggccatg

SEQ ID NO: 10057987 - DNA, 22 bp, Homo sapiens
tgctgtcaagaaaacaagcaat

SEQ ID NO: 10057988 - DNA, 22 bp, Homo sapiens
tgctggtggagaaagtggaggt

SEQ ID NO: 10057989 - DNA, 21 bp, Homo sapiens
tgctggtgagctcatgtggct

SEQ ID NO: 10057990 - DNA, 22 bp, Homo sapiens
tgctggaggcagtggaggtgcc

SEQ ID NO: 10057991 - DNA, 19 bp, Homo sapiens
tgctggaggttgacagggt

SEQ ID NO: 10057992 - DNA, 22 bp, Homo sapiens
tgctggcttatttagtaaatgt

SEQ ID NO: 10057993 - DNA, 22 bp, Homo sapiens
tgctggcttagatatcactgcc

SEQ ID NO: 10057994 - DNA, 23 bp, Homo sapiens
tgctggcttccagctgctccctc

SEQ ID NO: 10057995 - DNA, 22 bp, Homo sapiens
tgctggctgttctagggaggcc

SEQ ID NO: 10057996 - DNA, 23 bp, Homo sapiens
tgctggctgtgttattgccaaca

SEQ ID NO: 10057997 - DNA, 22 bp, Homo sapiens
tgctggctgtccctacctggct

SEQ ID NO: 10057998 - DNA, 22 bp, Homo sapiens
tgctggctgtgtaccatctcaa

SEQ ID NO: 10057999 - DNA, 22 bp, Homo sapiens
tgctggctgtatatgtgagagt

SEQ ID NO: 10058000 - DNA, 22 bp, Homo sapiens
tgctggctggcctggcctggac

SEQ ID NO: 10058001 - DNA, 22 bp, Homo sapiens
tgctggctgggctgctggagac

SEQ ID NO: 10058002 - DNA, 22 bp, Homo sapiens
tgctggctggagtgcctctgga

SEQ ID NO: 10058003 - DNA, 22 bp, Homo sapiens
tgctggctggatcagagattgg

SEQ ID NO: 10058004 - DNA, 22 bp, Homo sapiens
tgctggctgcagtgctgtcaaa

SEQ ID NO: 10058005 - DNA, 22 bp, Homo sapiens
tgctggctgccaggttccctgt

SEQ ID NO: 10058006 - DNA, 22 bp, Homo sapiens
tgctggctcctcgaggcttcgt

SEQ ID NO: 10058007 - DNA, 22 bp, Homo sapiens
tgctggctctaggctgagacag

SEQ ID NO: 10058008 - DNA, 22 bp, Homo sapiens
tgctggctctgggccaagcagg

SEQ ID NO: 10058009 - DNA, 22 bp, Homo sapiens
tgctggctgaggcctgagcggg

SEQ ID NO: 10058010 - DNA, 21 bp, Homo sapiens
tgctggctgaaaggcacagag

SEQ ID NO: 10058011 - DNA, 21 bp, Homo sapiens
tgctggctgaaaggcacagag

SEQ ID NO: 10058012 - DNA, 23 bp, Homo sapiens
tgctggctgaaacagccaaagga

SEQ ID NO: 10058013 - DNA, 22 bp, Homo sapiens
tgctggctatttaaagaagaaa

SEQ ID NO: 10058014 - DNA, 22 bp, Homo sapiens
tgctggctcagtttgcagactc

SEQ ID NO: 10058015 - DNA, 22 bp, Homo sapiens
tgctggctcccaggagccgctg

SEQ ID NO: 10058016 - DNA, 22 bp, Homo sapiens
tgctggctccaacctggcatct

SEQ ID NO: 10058017 - DNA, 22 bp, Homo sapiens
tgctggctactgatggcaggcc

SEQ ID NO: 10058018 - DNA, 19 bp, Homo sapiens
tgctgctgtccttgcaggg

SEQ ID NO: 10058019 - DNA, 19 bp, Homo sapiens
tgctgctgtccttgcaggg

SEQ ID NO: 10058020 - DNA, 22 bp, Homo sapiens
tgctgctgggtttgacagtcac

SEQ ID NO: 10058021 - DNA, 22 bp, Homo sapiens
tgctgctgtatcatgccttcat

SEQ ID NO: 10058022 - DNA, 20 bp, Homo sapiens
tgctgctttgccactagttg

SEQ ID NO: 10058023 - DNA, 22 bp, Homo sapiens
tgctgctttgatgtgtaaatca

SEQ ID NO: 10058024 - DNA, 22 bp, Homo sapiens
tgctgcttgttttgtaaataaa

SEQ ID NO: 10058025 - DNA, 22 bp, Homo sapiens
tgctgctgttgacggctgtcca

SEQ ID NO: 10058026 - DNA, 22 bp, Homo sapiens
tgctggagaactgctctgtgtt

SEQ ID NO: 10058027 - DNA, 22 bp, Homo sapiens
tgctggagaagctcctgggact

SEQ ID NO: 10058028 - DNA, 22 bp, Homo sapiens
tgctgcatttgcagtcctttaa

SEQ ID NO: 10058029 - DNA, 22 bp, Homo sapiens
tgctgctgatgcatagtctgct

SEQ ID NO: 10058030 - DNA, 22 bp, Homo sapiens
tgctgctgacatttggggcttg

SEQ ID NO: 10058031 - DNA, 22 bp, Homo sapiens
tggctgtgtcatcatagctgtg

SEQ ID NO: 10058032 - DNA, 22 bp, Homo sapiens
tggcttcaaaatctagtggtct

SEQ ID NO: 10058033 - DNA, 19 bp, Homo sapiens
tggctgggtgccaatggcc

SEQ ID NO: 10058034 - DNA, 21 bp, Homo sapiens
tggctggtggcagggcttctc

SEQ ID NO: 10058035 - DNA, 22 bp, Homo sapiens
tggctggtgggcctcagcctgc

SEQ ID NO: 10058036 - DNA, 22 bp, Homo sapiens
tggctggttttggtgagctccg

SEQ ID NO: 10058037 - DNA, 22 bp, Homo sapiens
tggctggtcacatggtaggtct

SEQ ID NO: 10058038 - DNA, 22 bp, Homo sapiens
tggctggggagccccgactccc

SEQ ID NO: 10058039 - DNA, 22 bp, Homo sapiens
tggctgggccgggccttgtgcc

SEQ ID NO: 10058040 - DNA, 19 bp, Homo sapiens
tggctgggcgtgcctccgt

SEQ ID NO: 10058041 - DNA, 19 bp, Homo sapiens
tggctgggcgtgcctccgt

SEQ ID NO: 10058042 - DNA, 22 bp, Homo sapiens
tggctgggagctggaactgggc

SEQ ID NO: 10058043 - DNA, 22 bp, Homo sapiens
tggctgggcccccacctgcctc

SEQ ID NO: 10058044 - DNA, 22 bp, Homo sapiens
tggctttatacttaagcacaat

SEQ ID NO: 10058045 - DNA, 21 bp, Homo sapiens
tggcttttatggagctctggg

SEQ ID NO: 10058046 - DNA, 22 bp, Homo sapiens
tggcttttgttggtaccacctt

SEQ ID NO: 10058047 - DNA, 22 bp, Homo sapiens
tgggaaagtaattgtcatcctt

SEQ ID NO: 10058048 - DNA, 22 bp, Homo sapiens
tgggaaagtgtagcctgcaggc

SEQ ID NO: 10058049 - DNA, 22 bp, Homo sapiens
tgggaaagtgtagcctgcaggc

SEQ ID NO: 10058050 - DNA, 22 bp, Homo sapiens
tggcttctccctctgcctgatt

SEQ ID NO: 10058051 - DNA, 22 bp, Homo sapiens
tgggagcaggaagcaggaagta

SEQ ID NO: 10058052 - DNA, 19 bp, Homo sapiens
tgggagaggcaacagagta

SEQ ID NO: 10058053 - DNA, 22 bp, Homo sapiens
tgggagaagcagtgggacagta

SEQ ID NO: 10058054 - DNA, 20 bp, Homo sapiens
tgggactgacccatctgagc

SEQ ID NO: 10058055 - DNA, 22 bp, Homo sapiens
tgggaagggtcaacagctggaa

SEQ ID NO: 10058056 - DNA, 22 bp, Homo sapiens
tgggaaggggagctggaaagga

SEQ ID NO: 10058057 - DNA, 22 bp, Homo sapiens
tggctcaagtaacaaaaatata

SEQ ID NO: 10058058 - DNA, 22 bp, Homo sapiens
tggcctgggtgctgctgacatc

SEQ ID NO: 10058059 - DNA, 22 bp, Homo sapiens
tggcctggttgttgctgccgtt

SEQ ID NO: 10058060 - DNA, 22 bp, Homo sapiens
tggctccagatctgtctcctgt

SEQ ID NO: 10058061 - DNA, 22 bp, Homo sapiens
tggctgctcaagggaggaggct

SEQ ID NO: 10058062 - DNA, 22 bp, Homo sapiens
tggctgctctcttccccagggt

SEQ ID NO: 10058063 - DNA, 22 bp, Homo sapiens
tggctctggagctcctgggccc

SEQ ID NO: 10058064 - DNA, 20 bp, Homo sapiens
tggcacagaacccttgccta

SEQ ID NO: 10058065 - DNA, 22 bp, Homo sapiens
tggcacagaaaaatgctccatt

SEQ ID NO: 10058066 - DNA, 22 bp, Homo sapiens
tggcactgccaacctgctaggt

SEQ ID NO: 10058067 - DNA, 22 bp, Homo sapiens
tggcacttaaaaattattcttc

SEQ ID NO: 10058068 - DNA, 22 bp, Homo sapiens
tggcagagtcatcacatctgga

SEQ ID NO: 10058069 - DNA, 22 bp, Homo sapiens
tggcagagtcatcacatctgga

SEQ ID NO: 10058070 - DNA, 22 bp, Homo sapiens
tggcagccatcagagcaggggt

SEQ ID NO: 10058071 - DNA, 22 bp, Homo sapiens
tggcagccatcagagcaggggt

SEQ ID NO: 10058072 - DNA, 22 bp, Homo sapiens
tggcagccatctgagggtgggg

SEQ ID NO: 10058073 - DNA, 21 bp, Homo sapiens
tggcaggcagctggaagcttg

SEQ ID NO: 10058074 - DNA, 21 bp, Homo sapiens
tggcaggcagctggaagcttg

SEQ ID NO: 10058075 - DNA, 23 bp, Homo sapiens
tggcccgggctcagaggcagtgc

SEQ ID NO: 10058076 - DNA, 22 bp, Homo sapiens
tggccctgaatcaaggccagca

SEQ ID NO: 10058077 - DNA, 22 bp, Homo sapiens
tggccctgaggacccagtgtgg

SEQ ID NO: 10058078 - DNA, 22 bp, Homo sapiens
tggccctgagggctcggagcca

SEQ ID NO: 10058079 - DNA, 22 bp, Homo sapiens
tggccctgcacccagagcagtt

SEQ ID NO: 10058080 - DNA, 22 bp, Homo sapiens
tggccctgtggaggtcagtgag

SEQ ID NO: 10058081 - DNA, 22 bp, Homo sapiens
tggccctggtggcacagcctgc

SEQ ID NO: 10058082 - DNA, 22 bp, Homo sapiens
tggccctgtctgcacacaggat

SEQ ID NO: 10058083 - DNA, 22 bp, Homo sapiens
tggcctgactgtcaggctgtat

SEQ ID NO: 10058084 - DNA, 22 bp, Homo sapiens
tggcctctttcttccctttgac

SEQ ID NO: 10058085 - DNA, 18 bp, Homo sapiens
tggcctggagacaactct

SEQ ID NO: 10058086 - DNA, 22 bp, Homo sapiens
tggccagcagagttcactctct

SEQ ID NO: 10058087 - DNA, 22 bp, Homo sapiens
tggccaggccggggacagaact

SEQ ID NO: 10058088 - DNA, 22 bp, Homo sapiens
tggccaggctggtctggaacgc

SEQ ID NO: 10058089 - DNA, 22 bp, Homo sapiens
tggcagtggataggggagcggt

SEQ ID NO: 10058090 - DNA, 22 bp, Homo sapiens
tggcatgggccagggagagctg

SEQ ID NO: 10058091 - DNA, 22 bp, Homo sapiens
tggcatgggtggagagagcaca

SEQ ID NO: 10058092 - DNA, 21 bp, Homo sapiens
tggcatggaggtagcagtgtg

SEQ ID NO: 10058093 - DNA, 22 bp, Homo sapiens
tggcatggcaaccctgcaggga

SEQ ID NO: 10058094 - DNA, 17 bp, Homo sapiens
tggcatcttttgctcat

SEQ ID NO: 10058095 - DNA, 22 bp, Homo sapiens
tggcagtccctctggtagcacc

SEQ ID NO: 10058096 - DNA, 22 bp, Homo sapiens
aaacaggtagccctagccttct

SEQ ID NO: 10058097 - DNA, 22 bp, Homo sapiens
aagcaggagatgggtgcttttc

SEQ ID NO: 10058098 - DNA, 22 bp, Homo sapiens
accatgttggccaagctggtct

SEQ ID NO: 10058099 - DNA, 22 bp, Homo sapiens
agaaggctaaagaaacagattg

SEQ ID NO: 10058100 - DNA, 22 bp, Homo sapiens
ctgtcttttcttctcattgatg

SEQ ID NO: 10058101 - DNA, 22 bp, Homo sapiens
aggtggggctgggaaagattcc

SEQ ID NO: 10058102 - DNA, 22 bp, Homo sapiens
ctcttcttgtctctggttagaa

SEQ ID NO: 10058103 - DNA, 22 bp, Homo sapiens
ctcttcttggcccccatgaggg

SEQ ID NO: 10058104 - DNA, 22 bp, Homo sapiens
ctccttttcctactcatactat

SEQ ID NO: 10058105 - DNA, 22 bp, Homo sapiens
cagcttctgtcctagaaactgg

SEQ ID NO: 10058106 - DNA, 22 bp, Homo sapiens
agctctctcatgacagtgcagt

SEQ ID NO: 10058107 - DNA, 22 bp, Homo sapiens
ccaggcatccattgcttcctct

SEQ ID NO: 10058108 - DNA, 22 bp, Homo sapiens
cctcgacctccccaggctcagg

SEQ ID NO: 10058109 - DNA, 22 bp, Homo sapiens
cagtcctttctgaaatcctata

SEQ ID NO: 10058110 - DNA, 21 bp, Homo sapiens
tacatcagttttcttggctca

SEQ ID NO: 10058111 - DNA, 22 bp, Homo sapiens
caggaacatgttggaaagaaat

SEQ ID NO: 10058112 - DNA, 22 bp, Homo sapiens
caggaacaatcttactactatt

SEQ ID NO: 10058113 - DNA, 19 bp, Homo sapiens
tggtgcgctgttcctgagc

SEQ ID NO: 10058114 - DNA, 22 bp, Homo sapiens
ctgagagaagagcgcagtttgt

SEQ ID NO: 10058115 - DNA, 21 bp, Homo sapiens
ctctttgtggcaatgtatttt

SEQ ID NO: 10058116 - DNA, 22 bp, Homo sapiens
ttccttttagaatcatgaagac

SEQ ID NO: 10058117 - DNA, 22 bp, Homo sapiens
ttgacctatgtttcttcatctg

SEQ ID NO: 10058118 - DNA, 22 bp, Homo sapiens
ttgacccaaggccctggaattg

SEQ ID NO: 10058119 - DNA, 22 bp, Homo sapiens
gaccatcctggccaacgtggta

SEQ ID NO: 10058120 - DNA, 22 bp, Homo sapiens
gagtgtctatgtttagtctttc

SEQ ID NO: 10058121 - DNA, 22 bp, Homo sapiens
gagtgtctgtgacagctcatga

SEQ ID NO: 10058122 - DNA, 22 bp, Homo sapiens
gcctcctgtcccaggctgagga

SEQ ID NO: 10058123 - DNA, 22 bp, Homo sapiens
gccttagcatcttaaagctgtg

SEQ ID NO: 10058124 - DNA, 22 bp, Homo sapiens
gctctctttaaactgcatggct

SEQ ID NO: 10058125 - DNA, 22 bp, Homo sapiens
gttttttgggtgtatatcttct

SEQ ID NO: 10058126 - DNA, 22 bp, Homo sapiens
gtgtcctcttattgctcttggc

SEQ ID NO: 10058127 - DNA, 22 bp, Homo sapiens
gcttctatccctccactgcact

SEQ ID NO: 10058128 - DNA, 20 bp, Homo sapiens
gcttccttcccagcccccac

SEQ ID NO: 10058129 - DNA, 22 bp, Homo sapiens
gcttccttattgttgccatagt

SEQ ID NO: 10058130 - DNA, 22 bp, Homo sapiens
gcttccttggtcctggtctaag

SEQ ID NO: 10058131 - DNA, 22 bp, Homo sapiens
gcttccttgggaaaattagatg

SEQ ID NO: 10058132 - DNA, 22 bp, Homo sapiens
gcttccttctaccacatcatgc

SEQ ID NO: 10058133 - DNA, 22 bp, Homo sapiens
gcttccttccttacattggtgg

SEQ ID NO: 10058134 - DNA, 22 bp, Homo sapiens
ggcaggtgctaagagaggtaaa

SEQ ID NO: 10058135 - DNA, 22 bp, Homo sapiens
tgctcatcaacatgatgatcat

SEQ ID NO: 10058136 - DNA, 22 bp, Homo sapiens
tgcttcttcctccatgtgttct

SEQ ID NO: 10058137 - DNA, 22 bp, Homo sapiens
tgctttgctggcactcctggct

SEQ ID NO: 10058138 - DNA, 22 bp, Homo sapiens
tggagagaagaggcagtgtgct

SEQ ID NO: 10058139 - DNA, 22 bp, Homo sapiens
tggggaaagatagttttctcta

SEQ ID NO: 10058140 - DNA, 22 bp, Homo sapiens
tggtattacttctagacacaag

SEQ ID NO: 10058141 - DNA, 22 bp, Homo sapiens
tgtctcctaatgtctgtttcct

SEQ ID NO: 10058142 - DNA, 22 bp, Homo sapiens
tgtctctcatttagttttgcac

SEQ ID NO: 10058143 - DNA, 18 bp, Homo sapiens
tgtctctcctttctgtgt

SEQ ID NO: 10058144 - DNA, 20 bp, Homo sapiens
tgtctctcggttttgtgact

SEQ ID NO: 10058145 - DNA, 18 bp, Homo sapiens
tctttgtttccttcttgc

SEQ ID NO: 10058146 - DNA, 22 bp, Homo sapiens
tgaatccttcgcacttagacat

SEQ ID NO: 10058147 - DNA, 22 bp, Homo sapiens
tgagagaaacgttccttacatc

SEQ ID NO: 10058148 - DNA, 22 bp, Homo sapiens
tgagaaaatccagaggctagtt

SEQ ID NO: 10058149 - DNA, 17 bp, Homo sapiens
tgagacagggcaggccc

SEQ ID NO: 10058150 - DNA, 22 bp, Homo sapiens
tgagacagtcaccaggcaggcc

SEQ ID NO: 10058151 - DNA, 22 bp, Homo sapiens
tcctttccctttccatcctggc

SEQ ID NO: 10058152 - DNA, 22 bp, Homo sapiens
tccttttctctagtaagcttta

SEQ ID NO: 10058153 - DNA, 22 bp, Homo sapiens
tccttgaggaggtgacactgga

SEQ ID NO: 10058154 - DNA, 22 bp, Homo sapiens
tctctctttttaatcatgtaat

SEQ ID NO: 10058155 - DNA, 22 bp, Homo sapiens
tctcatgctgtagtgcactaac

SEQ ID NO: 10058156 - DNA, 22 bp, Homo sapiens
tctcgctctgtcgcccaggctg

SEQ ID NO: 10058157 - DNA, 22 bp, Homo sapiens
tctgatctgtgccttaggcctg

SEQ ID NO: 10058158 - DNA, 22 bp, Homo sapiens
tcttctttgaatcatagtgacc

SEQ ID NO: 10058159 - DNA, 22 bp, Homo sapiens
tcttcttttatttcaagggtgt

SEQ ID NO: 10058160 - DNA, 22 bp, Homo sapiens
tcttccttcgcccttgctgttt

SEQ ID NO: 10058161 - DNA, 22 bp, Homo sapiens
tcttccttaaatgtttggtaga

SEQ ID NO: 10058162 - DNA, 22 bp, Homo sapiens
tcttccttctttgatgacaagg

SEQ ID NO: 10058163 - DNA, 22 bp, Homo sapiens
tcttccttgccttgcttcatca

SEQ ID NO: 10058164 - DNA, 22 bp, Homo sapiens
tcttccttgctccttgtcactt

SEQ ID NO: 10058165 - DNA, 22 bp, Homo sapiens
tcttccttgtaagggctttaga

SEQ ID NO: 10058166 - DNA, 22 bp, Homo sapiens
tcttcctttcattcatgtgtta

SEQ ID NO: 10058167 - DNA, 22 bp, Homo sapiens
tcttccttttgtaccttctgaa

SEQ ID NO: 10058168 - DNA, 16 bp, Homo sapiens
tcttccttttgatttt

SEQ ID NO: 10058169 - DNA, 22 bp, Homo sapiens
tcttgagaagcggctgtctcag

SEQ ID NO: 10058170 - DNA, 22 bp, Homo sapiens
tcttgacattgttgttagcagg

SEQ ID NO: 10058171 - DNA, 22 bp, Homo sapiens
tcttgacattgcaatcttcaga

SEQ ID NO: 10058172 - DNA, 22 bp, Homo sapiens
tctttgaagttcccctggaaga

SEQ ID NO: 10058173 - DNA, 22 bp, Homo sapiens
tctttgaatacaggaagcatga

SEQ ID NO: 10058174 - DNA, 22 bp, Homo sapiens
tctttgaatcctttacatctga

SEQ ID NO: 10058175 - DNA, 23 bp, Homo sapiens
aagttctgattgtttttccatag

SEQ ID NO: 10058176 - DNA, 22 bp, Homo sapiens
aactatgttaataagtttcatt

SEQ ID NO: 10058177 - DNA, 22 bp, Homo sapiens
acagacatcatcaacatcttcc

SEQ ID NO: 10058178 - DNA, 22 bp, Homo sapiens
acaggtgtatgaatatgttcca

SEQ ID NO: 10058179 - DNA, 22 bp, Homo sapiens
acaggtagcatttttcctcttt

SEQ ID NO: 10058180 - DNA, 22 bp, Homo sapiens
acattacctggcatttgatctt

SEQ ID NO: 10058181 - DNA, 22 bp, Homo sapiens
agcaggaagtagtctgtaagca

SEQ ID NO: 10058182 - DNA, 22 bp, Homo sapiens
agagaagggtagcccattctcc

SEQ ID NO: 10058183 - DNA, 20 bp, Homo sapiens
accaggtggctgatgacacc

SEQ ID NO: 10058184 - DNA, 22 bp, Homo sapiens
acatcttttttctctaattgtg

SEQ ID NO: 10058185 - DNA, 22 bp, Homo sapiens
atacatcaaggatgatggtgta

SEQ ID NO: 10058186 - DNA, 22 bp, Homo sapiens
acttccttccaaacattcattt

SEQ ID NO: 10058187 - DNA, 22 bp, Homo sapiens
acttccttttcaaccatacagc

SEQ ID NO: 10058188 - DNA, 22 bp, Homo sapiens
acttccttttgggaaactgttt

SEQ ID NO: 10058189 - DNA, 22 bp, Homo sapiens
acttccttgtactgactccatt

SEQ ID NO: 10058190 - DNA, 22 bp, Homo sapiens
acttccttgtcaggtgcatcat

SEQ ID NO: 10058191 - DNA, 22 bp, Homo sapiens
agtgtccttagttagctttggg

SEQ ID NO: 10058192 - DNA, 22 bp, Homo sapiens
agtgtccttgattcctgttgtt

SEQ ID NO: 10058193 - DNA, 21 bp, Homo sapiens
agtgtccttgatcttgccttg

SEQ ID NO: 10058194 - DNA, 22 bp, Homo sapiens
agtgagtggagagctctaggtt

SEQ ID NO: 10058195 - DNA, 22 bp, Homo sapiens
agtggggagtttccagatgtgt

SEQ ID NO: 10058196 - DNA, 22 bp, Homo sapiens
agtgtcctacagctcctgcctg

SEQ ID NO: 10058197 - DNA, 22 bp, Homo sapiens
atcaggtgaagtcactgagtgg

SEQ ID NO: 10058198 - DNA, 22 bp, Homo sapiens
atcaggtgatgctctggttccc

SEQ ID NO: 10058199 - DNA, 22 bp, Homo sapiens
cttcctttcagaggaaggcctg

SEQ ID NO: 10058200 - DNA, 22 bp, Homo sapiens
aggctggagtgcagtggtgtga

SEQ ID NO: 10058201 - DNA, 22 bp, Homo sapiens
aggctggagtgtagcagtgcag

SEQ ID NO: 10058202 - DNA, 22 bp, Homo sapiens
aggctggagtgctggagtgctg

SEQ ID NO: 10058203 - DNA, 22 bp, Homo sapiens
cttgagagggagtagtttagga

SEQ ID NO: 10058204 - DNA, 22 bp, Homo sapiens
tcttttgtgccaagtaatgaat

SEQ ID NO: 10058205 - DNA, 22 bp, Homo sapiens
tcttttgtcggtgtatcatgga

SEQ ID NO: 10058206 - DNA, 22 bp, Homo sapiens
cagtcttctaacctagcagcct

SEQ ID NO: 10058207 - DNA, 22 bp, Homo sapiens
cttcctttccccaatcatatcg

SEQ ID NO: 10058208 - DNA, 20 bp, Homo sapiens
cttccttttccttcgtcaaa

SEQ ID NO: 10058209 - DNA, 22 bp, Homo sapiens
cttcctttggttggagcgccgt

SEQ ID NO: 10058210 - DNA, 22 bp, Homo sapiens
cttcctttgctgttcggaggtt

SEQ ID NO: 10058211 - DNA, 22 bp, Homo sapiens
tttttctgtctcttacattgca

SEQ ID NO: 10058212 - DNA, 22 bp, Homo sapiens
ttttcagttccatctctgctct

SEQ ID NO: 10058213 - DNA, 22 bp, Homo sapiens
ttacctaaaatagctcaattta

SEQ ID NO: 10058214 - DNA, 22 bp, Homo sapiens
gttcctttcctatttggataag

SEQ ID NO: 10058215 - DNA, 22 bp, Homo sapiens
gttcctttgtttagcagagaca

SEQ ID NO: 10058216 - DNA, 22 bp, Homo sapiens
tcctccgggcacgtcagtccct

SEQ ID NO: 10058217 - DNA, 22 bp, Homo sapiens
tcactggtctttggcttctcag

SEQ ID NO: 10058218 - DNA, 22 bp, Homo sapiens
tcaggctgaaaggactccagtt

SEQ ID NO: 10058219 - DNA, 22 bp, Homo sapiens
tcaggtgacctgagccactatg

SEQ ID NO: 10058220 - DNA, 22 bp, Homo sapiens
gccttagcctgcacttcctgtt

SEQ ID NO: 10058221 - DNA, 22 bp, Homo sapiens
gctcaagccttctgcccacctc

SEQ ID NO: 10058222 - DNA, 23 bp, Homo sapiens
ggcagcttatactttcatagaca

SEQ ID NO: 10058223 - DNA, 22 bp, Homo sapiens
ggcagcttaaaccacagacatt

SEQ ID NO: 10058224 - DNA, 18 bp, Homo sapiens
ggcagcttgactagcaac

SEQ ID NO: 10058225 - DNA, 22 bp, Homo sapiens
ggcagcttgtccttcaggagag

SEQ ID NO: 10058226 - DNA, 22 bp, Homo sapiens
ggcagcttggttgcagaccatc

SEQ ID NO: 10058227 - DNA, 22 bp, Homo sapiens
ttgcctcattttctggtgaaat

SEQ ID NO: 10058228 - DNA, 22 bp, Homo sapiens
ttgttgtcattgtagaggattt

SEQ ID NO: 10058229 - DNA, 22 bp, Homo sapiens
tttaacatgttcaagaaacata

SEQ ID NO: 10058230 - DNA, 22 bp, Homo sapiens
tttccttttggctaggtgtgaa

SEQ ID NO: 10058231 - DNA, 22 bp, Homo sapiens
tttccttttataaggcttgagg

SEQ ID NO: 10058232 - DNA, 22 bp, Homo sapiens
tttcctttgtgcaggccttggg

SEQ ID NO: 10058233 - DNA, 22 bp, Homo sapiens
tttccttttaagcagtcggcct

SEQ ID NO: 10058234 - DNA, 22 bp, Homo sapiens
tttcctttgagggtcctacact

SEQ ID NO: 10058235 - DNA, 22 bp, Homo sapiens
tttcctttgcccaatacatgtc

SEQ ID NO: 10058236 - DNA, 22 bp, Homo sapiens
tttcctttgggcacccgagctc

SEQ ID NO: 10058237 - DNA, 22 bp, Homo sapiens
tttcctttgggagcatgaattt

SEQ ID NO: 10058238 - DNA, 22 bp, Homo sapiens
tttcctttctggtttggtcata

SEQ ID NO: 10058239 - DNA, 21 bp, Homo sapiens
ttctccagggggagctctctc

SEQ ID NO: 10058240 - DNA, 22 bp, Homo sapiens
ttttacttcattcctgacttca

SEQ ID NO: 10058241 - DNA, 22 bp, Homo sapiens
ttttacattgggaaatgcctct

SEQ ID NO: 10058242 - DNA, 22 bp, Homo sapiens
ttttattgtctcccagttctgg

SEQ ID NO: 10058243 - DNA, 22 bp, Homo sapiens
tttgacattgccaatttgctca

SEQ ID NO: 10058244 - DNA, 22 bp, Homo sapiens
tttgacattatcctgttactgg

SEQ ID NO: 10058245 - DNA, 22 bp, Homo sapiens
tttgacatggaataactcattt

SEQ ID NO: 10058246 - DNA, 22 bp, Homo sapiens
tttgacatcactgacctgtttt

SEQ ID NO: 10058247 - DNA, 22 bp, Homo sapiens
tttgacatcaataccctagaat

SEQ ID NO: 10058248 - DNA, 22 bp, Homo sapiens
tttgaacaagagcttcacatta

SEQ ID NO: 10058249 - DNA, 22 bp, Homo sapiens
agtgttcttcctatctgctgtt

SEQ ID NO: 10058250 - DNA, 21 bp, Homo sapiens
agagacagagaaagtaacatt

SEQ ID NO: 10058251 - DNA, 22 bp, Homo sapiens
aactgctaactggtttgatact

SEQ ID NO: 10058252 - DNA, 22 bp, Homo sapiens
aaatcctgtccatttaccagat

SEQ ID NO: 10058253 - DNA, 22 bp, Homo sapiens
aagtggactaatacaaggacta

SEQ ID NO: 10058254 - DNA, 22 bp, Homo sapiens
aaggctgggaaacatgcaggcc

SEQ ID NO: 10058255 - DNA, 22 bp, Homo sapiens
acaggtgtggggctgtggtact

SEQ ID NO: 10058256 - DNA, 22 bp, Homo sapiens
acagttctgagctataattgct

SEQ ID NO: 10058257 - DNA, 20 bp, Homo sapiens
ctttgcctattctctgcctg

SEQ ID NO: 10058258 - DNA, 22 bp, Homo sapiens
attataggcttgagccaccgtg

SEQ ID NO: 10058259 - DNA, 22 bp, Homo sapiens
gtgagagatcccccactcatct

SEQ ID NO: 10058260 - DNA, 22 bp, Homo sapiens
gtgagagatgctttcttaacgc

SEQ ID NO: 10058261 - DNA, 22 bp, Homo sapiens
aggtattattagcatctctatt

SEQ ID NO: 10058262 - DNA, 22 bp, Homo sapiens
agtgtcctctattatgacttta

SEQ ID NO: 10058263 - DNA, 20 bp, Homo sapiens
agtggggagtcaggagtgcc

SEQ ID NO: 10058264 - DNA, 22 bp, Homo sapiens
agtggggacaatgagagcaggt

SEQ ID NO: 10058265 - DNA, 22 bp, Homo sapiens
agtggggaagagcatgggccct

SEQ ID NO: 10058266 - DNA, 22 bp, Homo sapiens
agtggggaagattttgcagtca

SEQ ID NO: 10058267 - DNA, 22 bp, Homo sapiens
agtggggacttatgccagcatt

SEQ ID NO: 10058268 - DNA, 22 bp, Homo sapiens
ctctgagaggtgagaagcagca

SEQ ID NO: 10058269 - DNA, 22 bp, Homo sapiens
ataggctttttaactctccaaa

SEQ ID NO: 10058270 - DNA, 22 bp, Homo sapiens
cagtgtctccagatgctccaat

SEQ ID NO: 10058271 - DNA, 22 bp, Homo sapiens
cagtgtctggttggctctacgt

SEQ ID NO: 10058272 - DNA, 22 bp, Homo sapiens
taggaacaagtttccttgctgt

SEQ ID NO: 10058273 - DNA, 21 bp, Homo sapiens
tactgtagccttgcactgtag

SEQ ID NO: 10058274 - DNA, 22 bp, Homo sapiens
ccaccaagtcccactataattt

SEQ ID NO: 10058275 - DNA, 21 bp, Homo sapiens
tgtaagtttcatctgaattgg

SEQ ID NO: 10058276 - DNA, 22 bp, Homo sapiens
tgcctcataacactcctggagt

SEQ ID NO: 10058277 - DNA, 22 bp, Homo sapiens
tgaacaggctgtactcatgagg

SEQ ID NO: 10058278 - DNA, 22 bp, Homo sapiens
ctctctttctgaatgaggacta

SEQ ID NO: 10058279 - DNA, 22 bp, Homo sapiens
tttcctttctcaagagccggca

SEQ ID NO: 10058280 - DNA, 22 bp, Homo sapiens
tttcctttctagaagcctaaat

SEQ ID NO: 10058281 - DNA, 22 bp, Homo sapiens
ttttgcctgtgaatactatctt

SEQ ID NO: 10058282 - DNA, 22 bp, Homo sapiens
tttgaccagaggtccctggaaa

SEQ ID NO: 10058283 - DNA, 22 bp, Homo sapiens
tttgacctccagaactataaga

SEQ ID NO: 10058284 - DNA, 22 bp, Homo sapiens
tttgaccttgttggtaggtatt

SEQ ID NO: 10058285 - DNA, 20 bp, Homo sapiens
tttgacctttatgaagataa

SEQ ID NO: 10058286 - DNA, 22 bp, Homo sapiens
cctttttcagcttctagaggct

SEQ ID NO: 10058287 - DNA, 22 bp, Homo sapiens
ccttgagccagggagctggcag

SEQ ID NO: 10058288 - DNA, 22 bp, Homo sapiens
ccttgccccatctgggaatccc

SEQ ID NO: 10058289 - DNA, 22 bp, Homo sapiens
ttgccctagggtcttatcctcc

SEQ ID NO: 10058290 - DNA, 21 bp, Homo sapiens
gccatttcacacagacatttg

SEQ ID NO: 10058291 - DNA, 22 bp, Homo sapiens
gtagttctgcagtgtcacctga

SEQ ID NO: 10058292 - DNA, 22 bp, Homo sapiens
ggctcactgcaacttccgcctc

SEQ ID NO: 10058293 - DNA, 19 bp, Homo sapiens
gttcttttcacctctgtgc

SEQ ID NO: 10058294 - DNA, 22 bp, Homo sapiens
tcaggctgttagccacctcctc

SEQ ID NO: 10058295 - DNA, 22 bp, Homo sapiens
tcatctttaccccttgcttcaa

SEQ ID NO: 10058296 - DNA, 22 bp, Homo sapiens
tcatacattcagcagatatttg

SEQ ID NO: 10058297 - DNA, 22 bp, Homo sapiens
tcatgcagttactgttatgcaa

SEQ ID NO: 10058298 - DNA, 21 bp, Homo sapiens
tcatgcaggcagagtttggta

SEQ ID NO: 10058299 - DNA, 22 bp, Homo sapiens
tttcatgaggtctttcagcaag

SEQ ID NO: 10058300 - DNA, 22 bp, Homo sapiens
ttgcagagaggttaggaactca

SEQ ID NO: 10058301 - DNA, 22 bp, Homo sapiens
ttgcagagccatgaggctggct

SEQ ID NO: 10058302 - DNA, 22 bp, Homo sapiens
ttgaaatcaggaaagttccagg

SEQ ID NO: 10058303 - DNA, 22 bp, Homo sapiens
ttcttttgcaagactattgatt

SEQ ID NO: 10058304 - DNA, 20 bp, Homo sapiens
ttcttttgataagcttgaca

SEQ ID NO: 10058305 - DNA, 22 bp, Homo sapiens
agagaaggcatagaacttgagt

SEQ ID NO: 10058306 - DNA, 22 bp, Homo sapiens
aatcctgtcttgccatccaata

SEQ ID NO: 10058307 - DNA, 22 bp, Homo sapiens
aagtgctgtacagtgtgtaaat

SEQ ID NO: 10058308 - DNA, 22 bp, Homo sapiens
aagtgctgtttctgatgaatgc

SEQ ID NO: 10058309 - DNA, 22 bp, Homo sapiens
aagtgctgggattataggcatg

SEQ ID NO: 10058310 - DNA, 22 bp, Homo sapiens
acacttggagcaacacttatgg

SEQ ID NO: 10058311 - DNA, 22 bp, Homo sapiens
agcttcttgtagaactcaaaag

SEQ ID NO: 10058312 - DNA, 22 bp, Homo sapiens
agcttcttccaggcagtgactc

SEQ ID NO: 10058313 - DNA, 22 bp, Homo sapiens
agcttcttcccagcctcacccg

SEQ ID NO: 10058314 - DNA, 22 bp, Homo sapiens
aggacttagaacattatgtact

SEQ ID NO: 10058315 - DNA, 22 bp, Homo sapiens
atttgaaatctgggttactctg

SEQ ID NO: 10058316 - DNA, 22 bp, Homo sapiens
atttgaaaacctgagcctcccg

SEQ ID NO: 10058317 - DNA, 22 bp, Homo sapiens
attcctttggactcctccttgc

SEQ ID NO: 10058318 - DNA, 22 bp, Homo sapiens
cagctgctttagttttccatcc

SEQ ID NO: 10058319 - DNA, 22 bp, Homo sapiens
atttcatgttaactgaacagaa

SEQ ID NO: 10058320 - DNA, 22 bp, Homo sapiens
gctttcttggttctgcaggggc

SEQ ID NO: 10058321 - DNA, 22 bp, Homo sapiens
ctgaatccattcatgcaagata

SEQ ID NO: 10058322 - DNA, 22 bp, Homo sapiens
ctcctgccaccgcggtgtcctg

SEQ ID NO: 10058323 - DNA, 22 bp, Homo sapiens
atctctttgatggctcctgtga

SEQ ID NO: 10058324 - DNA, 22 bp, Homo sapiens
taggctttagtccctggaatta

SEQ ID NO: 10058325 - DNA, 22 bp, Homo sapiens
tagcttctatacaacttcagca

SEQ ID NO: 10058326 - DNA, 22 bp, Homo sapiens
tagcttctcttttcaacatctt

SEQ ID NO: 10058327 - DNA, 22 bp, Homo sapiens
tctttcttgcaaggatgcagga

SEQ ID NO: 10058328 - DNA, 20 bp, Homo sapiens
tgagaaggggtcagctgtac

SEQ ID NO: 10058329 - DNA, 22 bp, Homo sapiens
cctagagctctgctttatctaa

SEQ ID NO: 10058330 - DNA, 22 bp, Homo sapiens
ccttccttgtctacaaaagctc

SEQ ID NO: 10058331 - DNA, 22 bp, Homo sapiens
ccttccttgagaagcaattcct

SEQ ID NO: 10058332 - DNA, 22 bp, Homo sapiens
ccttccttcaagcacacatcta

SEQ ID NO: 10058333 - DNA, 22 bp, Homo sapiens
ccttcctttcagggctatgcct

SEQ ID NO: 10058334 - DNA, 22 bp, Homo sapiens
ccttcctttgcaggtcaggtca

SEQ ID NO: 10058335 - DNA, 22 bp, Homo sapiens
ccttccttttactgtctccgga

SEQ ID NO: 10058336 - DNA, 22 bp, Homo sapiens
ccttcctttgcatcatttctag

SEQ ID NO: 10058337 - DNA, 23 bp, Homo sapiens
tgttccagatacgccttttcctc

SEQ ID NO: 10058338 - DNA, 22 bp, Homo sapiens
tttgcctagtagattacctgtt

SEQ ID NO: 10058339 - DNA, 20 bp, Homo sapiens
tttgcccttcctctgccttt

SEQ ID NO: 10058340 - DNA, 22 bp, Homo sapiens
tttcctttatgacatcaccact

SEQ ID NO: 10058341 - DNA, 20 bp, Homo sapiens
tttcctttcattttagtacc

SEQ ID NO: 10058342 - DNA, 22 bp, Homo sapiens
tttcctttccaaaattctgcct

SEQ ID NO: 10058343 - DNA, 22 bp, Homo sapiens
ctcttcttggaatgctgactgt

SEQ ID NO: 10058344 - DNA, 22 bp, Homo sapiens
ctcttcttgctagactgagtgc

SEQ ID NO: 10058345 - DNA, 22 bp, Homo sapiens
gacaggtgtgtgtatattaggg

SEQ ID NO: 10058346 - DNA, 22 bp, Homo sapiens
gacaggtgggttctcgtatctg

SEQ ID NO: 10058347 - DNA, 18 bp, Homo sapiens
gacaggtgggtgagacca

SEQ ID NO: 10058348 - DNA, 22 bp, Homo sapiens
gacaggtggggaaactaaggta

SEQ ID NO: 10058349 - DNA, 22 bp, Homo sapiens
gacaggtgggtacctttatgga

SEQ ID NO: 10058350 - DNA, 22 bp, Homo sapiens
gagcttcttgtttcttcatctg

SEQ ID NO: 10058351 - DNA, 22 bp, Homo sapiens
gcctcctgaaaggaagagctcc

SEQ ID NO: 10058352 - DNA, 18 bp, Homo sapiens
gtttcatgcatgtgaaac

SEQ ID NO: 10058353 - DNA, 20 bp, Homo sapiens
tcagccttctcatcctgggg

SEQ ID NO: 10058354 - DNA, 22 bp, Homo sapiens
ttgtttttatgaacatccagga

SEQ ID NO: 10058355 - DNA, 22 bp, Homo sapiens
ttctgctatacttatgaataca

SEQ ID NO: 10058356 - DNA, 22 bp, Homo sapiens
tgttctcactggatgcttcaca

SEQ ID NO: 10058357 - DNA, 22 bp, Homo sapiens
ttagacattaaatgccatttaa

SEQ ID NO: 10058358 - DNA, 22 bp, Homo sapiens
cctgttcaccctccatgcacag

SEQ ID NO: 10058359 - DNA, 22 bp, Homo sapiens
cagtatttgttacagcattagc

SEQ ID NO: 10058360 - DNA, 22 bp, Homo sapiens
catttattggttaggccagcag

SEQ ID NO: 10058361 - DNA, 22 bp, Homo sapiens
aggcaagaacagacatgggagt

SEQ ID NO: 10058362 - DNA, 21 bp, Homo sapiens
caataaactgcacattgagac

SEQ ID NO: 10058363 - DNA, 22 bp, Homo sapiens
cagaaataaagtggacagagta

SEQ ID NO: 10058364 - DNA, 22 bp, Homo sapiens
gtcccttcctcattccacttta

SEQ ID NO: 10058365 - DNA, 22 bp, Homo sapiens
caaaggaagctccttgatggcg

SEQ ID NO: 10058366 - DNA, 22 bp, Homo sapiens
caaaggaaatactaatctggaa

SEQ ID NO: 10058367 - DNA, 22 bp, Homo sapiens
attctttaattcaattgaagga

SEQ ID NO: 10058368 - DNA, 22 bp, Homo sapiens
gacaattgcttttgccgaataa

SEQ ID NO: 10058369 - DNA, 22 bp, Homo sapiens
gacacaaagtttgtcagaaatt

SEQ ID NO: 10058370 - DNA, 22 bp, Homo sapiens
gagagcaatggggacgggcagg

SEQ ID NO: 10058371 - DNA, 23 bp, Homo sapiens
gagagcaatgagatgtaaacact

SEQ ID NO: 10058372 - DNA, 22 bp, Homo sapiens
agcagagacatgaaatatgctt

SEQ ID NO: 10058373 - DNA, 18 bp, Homo sapiens
cacaggctcccagtgagg

SEQ ID NO: 10058374 - DNA, 22 bp, Homo sapiens
agcatttccgccctcttctgcc

SEQ ID NO: 10058375 - DNA, 22 bp, Homo sapiens
cactgcacttcagcctgggtga

SEQ ID NO: 10058376 - DNA, 22 bp, Homo sapiens
cactgcactccatcctgggaaa

SEQ ID NO: 10058377 - DNA, 22 bp, Homo sapiens
attcctttggactcctccttgc

SEQ ID NO: 10058378 - DNA, 22 bp, Homo sapiens
attgtattctgcacctttgtta

SEQ ID NO: 10058379 - DNA, 22 bp, Homo sapiens
attgtggtgtcagttataggca

SEQ ID NO: 10058380 - DNA, 22 bp, Homo sapiens
agatttatgtggtcacactcag

SEQ ID NO: 10058381 - DNA, 22 bp, Homo sapiens
agcaatgactttgaaatcatga

SEQ ID NO: 10058382 - DNA, 22 bp, Homo sapiens
aggcagtgtgtagctggaagag

SEQ ID NO: 10058383 - DNA, 22 bp, Homo sapiens
agaaagaacgttggttatctta

SEQ ID NO: 10058384 - DNA, 22 bp, Homo sapiens
agttgcagacgcagagatgttg

SEQ ID NO: 10058385 - DNA, 22 bp, Homo sapiens
atagaacagaaacagatgcaca

SEQ ID NO: 10058386 - DNA, 22 bp, Homo sapiens
aagaagagaaatgtgctgctgg

SEQ ID NO: 10058387 - DNA, 22 bp, Homo sapiens
aagaacatgttaaaagattcac

SEQ ID NO: 10058388 - DNA, 22 bp, Homo sapiens
aagaacattttgtagaatgaca

SEQ ID NO: 10058389 - DNA, 22 bp, Homo sapiens
aaaggaatgagcttctgttagg

SEQ ID NO: 10058390 - DNA, 22 bp, Homo sapiens
aaaagcaaggcagtctgtctga

SEQ ID NO: 10058391 - DNA, 22 bp, Homo sapiens
aaaagcaagaggctggattaaa

SEQ ID NO: 10058392 - DNA, 22 bp, Homo sapiens
aaaacatgtccatacagaaact

SEQ ID NO: 10058393 - DNA, 22 bp, Homo sapiens
aaaagcaagttgcctaggttga

SEQ ID NO: 10058394 - DNA, 22 bp, Homo sapiens
aaaggaatattcaaaacagtca

SEQ ID NO: 10058395 - DNA, 20 bp, Homo sapiens
aaaggaatatatgaagtata

SEQ ID NO: 10058396 - DNA, 17 bp, Homo sapiens
aaggaatgtcagaagtt

SEQ ID NO: 10058397 - DNA, 16 bp, Homo sapiens
aaggaatgtcattctg

SEQ ID NO: 10058398 - DNA, 19 bp, Homo sapiens
aaggaatggctttaagtag

SEQ ID NO: 10058399 - DNA, 21 bp, Homo sapiens
aaggaatgaatggatggatga

SEQ ID NO: 10058400 - DNA, 22 bp, Homo sapiens
aaggaatgctctaggagggcag

SEQ ID NO: 10058401 - DNA, 22 bp, Homo sapiens
aagtccctggtgctggctgcgc

SEQ ID NO: 10058402 - DNA, 22 bp, Homo sapiens
aagtccctttaatcagtgcctt

SEQ ID NO: 10058403 - DNA, 22 bp, Homo sapiens
aagtccctggttcctagcaaaa

SEQ ID NO: 10058404 - DNA, 22 bp, Homo sapiens
agagcaatggcatccagctgat

SEQ ID NO: 10058405 - DNA, 22 bp, Homo sapiens
agagcaatttcttctccaagtt

SEQ ID NO: 10058406 - DNA, 22 bp, Homo sapiens
taactactaattgatgataatg

SEQ ID NO: 10058407 - DNA, 22 bp, Homo sapiens
tacaaagatagtgttagagtaa

SEQ ID NO: 10058408 - DNA, 22 bp, Homo sapiens
taatagaatagtggaaacattg

SEQ ID NO: 10058409 - DNA, 20 bp, Homo sapiens
tacaacaagtagagacatac

SEQ ID NO: 10058410 - DNA, 22 bp, Homo sapiens
tatccgtgatgtttataaacca

SEQ ID NO: 10058411 - DNA, 22 bp, Homo sapiens
tatatcatggagattaacattc

SEQ ID NO: 10058412 - DNA, 22 bp, Homo sapiens
tatcccaggaggccacctgtca

SEQ ID NO: 10058413 - DNA, 22 bp, Homo sapiens
gcaaactgttggagtagagtct

SEQ ID NO: 10058414 - DNA, 22 bp, Homo sapiens
gcagagaaggattgaaaccaga

SEQ ID NO: 10058415 - DNA, 22 bp, Homo sapiens
gtattgcaattactcttcttct

SEQ ID NO: 10058416 - DNA, 21 bp, Homo sapiens
gtattgcagagttatgtgctc

SEQ ID NO: 10058417 - DNA, 22 bp, Homo sapiens
gagcctggagctggaacgaagc

SEQ ID NO: 10058418 - DNA, 22 bp, Homo sapiens
tttcctttccaaaattctgcct

SEQ ID NO: 10058419 - DNA, 21 bp, Homo sapiens
cccttctgctccagctttgcc

SEQ ID NO: 10058420 - DNA, 22 bp, Homo sapiens
tgccagctcctgcagctcctgt

SEQ ID NO: 10058421 - DNA, 22 bp, Homo sapiens
tgctgtgttaaatacaagcatg

SEQ ID NO: 10058422 - DNA, 22 bp, Homo sapiens
tgaggcagaaattcctgttttc

SEQ ID NO: 10058423 - DNA, 23 bp, Homo sapiens
tgaggctgattgatttttgctca

SEQ ID NO: 10058424 - DNA, 22 bp, Homo sapiens
tgaggcagcccactttccttag

SEQ ID NO: 10058425 - DNA, 21 bp, Homo sapiens
cagtattttaagcagtgagtt

SEQ ID NO: 10058426 - DNA, 22 bp, Homo sapiens
catttattcatgatctgtagct

SEQ ID NO: 10058427 - DNA, 22 bp, Homo sapiens
catttattcatttgctagggct

SEQ ID NO: 10058428 - DNA, 22 bp, Homo sapiens
catctgttaaagtctaatgaaa

SEQ ID NO: 10058429 - DNA, 19 bp, Homo sapiens
tcagtcatatatctgcacc

SEQ ID NO: 10058430 - DNA, 22 bp, Homo sapiens
ttctgcctgccccagagaggcc

SEQ ID NO: 10058431 - DNA, 22 bp, Homo sapiens
ttgagcaattaggaaataaaga

SEQ ID NO: 10058432 - DNA, 22 bp, Homo sapiens
ttgagcaaaggagtaaaatgca

SEQ ID NO: 10058433 - DNA, 22 bp, Homo sapiens
ttgagcccaggaggcctgggtg

SEQ ID NO: 10058434 - DNA, 22 bp, Homo sapiens
tttcattttggttatgccataa

SEQ ID NO: 10058435 - DNA, 22 bp, Homo sapiens
tttcatttcatagaattgtgtt

SEQ ID NO: 10058436 - DNA, 22 bp, Homo sapiens
atagacaaacacgaagatgaca

SEQ ID NO: 10058437 - DNA, 22 bp, Homo sapiens
ctgggctgtcaatggccctctg

SEQ ID NO: 10058438 - DNA, 18 bp, Homo sapiens
agtcatttacttttgtga

SEQ ID NO: 10058439 - DNA, 22 bp, Homo sapiens
ctaaacaagggattataattga

SEQ ID NO: 10058440 - DNA, 22 bp, Homo sapiens
ctaaacaagatactaatgaggt

SEQ ID NO: 10058441 - DNA, 22 bp, Homo sapiens
aggctgaggtgtgctgtgatcg

SEQ ID NO: 10058442 - DNA, 22 bp, Homo sapiens
catttgttaagaaggaaaaagg

SEQ ID NO: 10058443 - DNA, 19 bp, Homo sapiens
catggtgaaaccccgtctc

SEQ ID NO: 10058444 - DNA, 22 bp, Homo sapiens
gggttcagtccctcttgctact

SEQ ID NO: 10058445 - DNA, 22 bp, Homo sapiens
cactgcactccagcttgggtga

SEQ ID NO: 10058446 - DNA, 22 bp, Homo sapiens
cactgcactccagcctgggtga

SEQ ID NO: 10058447 - DNA, 22 bp, Homo sapiens
cactgcactccagcctgggtca

SEQ ID NO: 10058448 - DNA, 22 bp, Homo sapiens
cactgcactccagcctgggcaa

SEQ ID NO: 10058449 - DNA, 22 bp, Homo sapiens
cactgcactccagcctgggaga

SEQ ID NO: 10058450 - DNA, 22 bp, Homo sapiens
caattgacaatgacagtgtcaa

SEQ ID NO: 10058451 - DNA, 22 bp, Homo sapiens
gattcattctcagtttctagag

SEQ ID NO: 10058452 - DNA, 22 bp, Homo sapiens
gatggcagcatattgacagcat

SEQ ID NO: 10058453 - DNA, 19 bp, Homo sapiens
attcatttttgccttctaa

SEQ ID NO: 10058454 - DNA, 22 bp, Homo sapiens
atgagcaaccttctcctccagc

SEQ ID NO: 10058455 - DNA, 22 bp, Homo sapiens
gaagtattactctgaatgtatt

SEQ ID NO: 10058456 - DNA, 22 bp, Homo sapiens
atggcagaatatctgcatcgca

SEQ ID NO: 10058457 - DNA, 22 bp, Homo sapiens
aaggcaggatgggaaaagattt

SEQ ID NO: 10058458 - DNA, 22 bp, Homo sapiens
acagtagatggctcagagacag

SEQ ID NO: 10058459 - DNA, 22 bp, Homo sapiens
aaggctgagtaaaacagagaac

SEQ ID NO: 10058460 - DNA, 22 bp, Homo sapiens
aaggctgattagactgatagct

SEQ ID NO: 10058461 - DNA, 22 bp, Homo sapiens
aagtatgaatcaaagactatct

SEQ ID NO: 10058462 - DNA, 22 bp, Homo sapiens
aagtcagagcaactgagacatt

SEQ ID NO: 10058463 - DNA, 22 bp, Homo sapiens
aagtcagagatgccaaagatta

SEQ ID NO: 10058464 - DNA, 22 bp, Homo sapiens
aagtcagaccttgttgatagct

SEQ ID NO: 10058465 - DNA, 22 bp, Homo sapiens
aagtcagacagctgagctgcct

SEQ ID NO: 10058466 - DNA, 22 bp, Homo sapiens
aagtcagaaaacagagcaatta

SEQ ID NO: 10058467 - DNA, 22 bp, Homo sapiens
acagaaattgggcaaatggaag

SEQ ID NO: 10058468 - DNA, 22 bp, Homo sapiens
acagaaattcaaactggaattt

SEQ ID NO: 10058469 - DNA, 22 bp, Homo sapiens
aaatagcagctttgacagcaca

SEQ ID NO: 10058470 - DNA, 22 bp, Homo sapiens
aaatagcaatgtgaaaagagga

SEQ ID NO: 10058471 - DNA, 22 bp, Homo sapiens
aactaagtcatagagtccctca

SEQ ID NO: 10058472 - DNA, 22 bp, Homo sapiens
aaaatgaataagttaacccagg

SEQ ID NO: 10058473 - DNA, 22 bp, Homo sapiens
aaaaatcacttttataggcagc

SEQ ID NO: 10058474 - DNA, 22 bp, Homo sapiens
aaaaaagattgatggtggatgc

SEQ ID NO: 10058475 - DNA, 22 bp, Homo sapiens
aaacaagtttagaataatgaat

SEQ ID NO: 10058476 - DNA, 23 bp, Homo sapiens
aaacaagtctctcaatggcttgc

SEQ ID NO: 10058477 - DNA, 22 bp, Homo sapiens
aaacaagtttgtagactagcca

SEQ ID NO: 10058478 - DNA, 22 bp, Homo sapiens
aactgaaacttaggaagtaatc

SEQ ID NO: 10058479 - DNA, 22 bp, Homo sapiens
aacaaagcaccactgagtcagt

SEQ ID NO: 10058480 - DNA, 22 bp, Homo sapiens
acaaagagggaccagtgacttg

SEQ ID NO: 10058481 - DNA, 22 bp, Homo sapiens
acacagctttgtgttgctccac

SEQ ID NO: 10058482 - DNA, 22 bp, Homo sapiens
atgtgggccgtgcgggtgtcct

SEQ ID NO: 10058483 - DNA, 22 bp, Homo sapiens
attgataaattgcaatggggct

SEQ ID NO: 10058484 - DNA, 22 bp, Homo sapiens
attcatttaggtattcacttac

SEQ ID NO: 10058485 - DNA, 22 bp, Homo sapiens
attcatttagagggattaagca

SEQ ID NO: 10058486 - DNA, 22 bp, Homo sapiens
cagaaatatttattgagtgaca

SEQ ID NO: 10058487 - DNA, 22 bp, Homo sapiens
cagaaatattccaagtactgca

SEQ ID NO: 10058488 - DNA, 22 bp, Homo sapiens
actgcacttcagcctgggtgac

SEQ ID NO: 10058489 - DNA, 22 bp, Homo sapiens
actgcacttcagcctgggtgtc

SEQ ID NO: 10058490 - DNA, 22 bp, Homo sapiens
acgcctgtaatcccagcacttt

SEQ ID NO: 10058491 - DNA, 22 bp, Homo sapiens
ataaacaagactggccaacttt

SEQ ID NO: 10058492 - DNA, 22 bp, Homo sapiens
atattcatcgtgtagaaatact

SEQ ID NO: 10058493 - DNA, 22 bp, Homo sapiens
tcattgttcctatttggcaaga

SEQ ID NO: 10058494 - DNA, 22 bp, Homo sapiens
tcatttctctgagtctgataat

SEQ ID NO: 10058495 - DNA, 22 bp, Homo sapiens
tcatttctgagccttccatgat

SEQ ID NO: 10058496 - DNA, 22 bp, Homo sapiens
tcatttatattgtattctgtag

SEQ ID NO: 10058497 - DNA, 22 bp, Homo sapiens
tcactgcaacctccacctcctg

SEQ ID NO: 10058498 - DNA, 22 bp, Homo sapiens
tcactgcaacctccacctcccg

SEQ ID NO: 10058499 - DNA, 23 bp, Homo sapiens
taaagcaaagtcaagtgcactcc

SEQ ID NO: 10058500 - DNA, 22 bp, Homo sapiens
taaagcaaaaatgaactgccat

SEQ ID NO: 10058501 - DNA, 22 bp, Homo sapiens
taaagcaaggaatagagtagtc

SEQ ID NO: 10058502 - DNA, 22 bp, Homo sapiens
taaagcaattactcagtggctt

SEQ ID NO: 10058503 - DNA, 22 bp, Homo sapiens
taaagcaatgaaagttttgcag

SEQ ID NO: 10058504 - DNA, 22 bp, Homo sapiens
taaagcaatttgagcaagttct

SEQ ID NO: 10058505 - DNA, 22 bp, Homo sapiens
taattgcagggtgtcagaatac

SEQ ID NO: 10058506 - DNA, 22 bp, Homo sapiens
tagatgaccttgtgttaggcaa

SEQ ID NO: 10058507 - DNA, 22 bp, Homo sapiens
tagcaaaatgtggatgtagttg

SEQ ID NO: 10058508 - DNA, 22 bp, Homo sapiens
tagcaaagcgaaagagatttat

SEQ ID NO: 10058509 - DNA, 22 bp, Homo sapiens
gcccctgggagcagagccacca

SEQ ID NO: 10058510 - DNA, 22 bp, Homo sapiens
ggagcctggtatagtgttgcat

SEQ ID NO: 10058511 - DNA, 22 bp, Homo sapiens
cggaggttgaggctgcagtgag

SEQ ID NO: 10058512 - DNA, 22 bp, Homo sapiens
tttcctttctagaagcctaaat

SEQ ID NO: 10058513 - DNA, 22 bp, Homo sapiens
tttattcatcatctgttcatat

SEQ ID NO: 10058514 - DNA, 22 bp, Homo sapiens
ctgtggaatcgggaaaagacag

SEQ ID NO: 10058515 - DNA, 20 bp, Homo sapiens
ctgtggaattttaccatgcg

SEQ ID NO: 10058516 - DNA, 22 bp, Homo sapiens
gaaaaatgctccaaatctgtgg

SEQ ID NO: 10058517 - DNA, 22 bp, Homo sapiens
gaaagacatagttgcaagatgg

SEQ ID NO: 10058518 - DNA, 22 bp, Homo sapiens
cttcttccagttataagagctt

SEQ ID NO: 10058519 - DNA, 22 bp, Homo sapiens
gagcaagactacaggcagatga

SEQ ID NO: 10058520 - DNA, 22 bp, Homo sapiens
gagcaagattaaaaggctgggt

SEQ ID NO: 10058521 - DNA, 22 bp, Homo sapiens
gacctggggtggaaggaaggca

SEQ ID NO: 10058522 - DNA, 22 bp, Homo sapiens
gagtaattgtgtctggcacact

SEQ ID NO: 10058523 - DNA, 22 bp, Homo sapiens
tgaaagcatgcttgccaagctt

SEQ ID NO: 10058524 - DNA, 22 bp, Homo sapiens
cccaggaccgcgcggctgagcg

SEQ ID NO: 10058525 - DNA, 22 bp, Homo sapiens
ccggctactcgggaggctgacg

SEQ ID NO: 10058526 - DNA, 22 bp, Homo sapiens
tggctaacaaggtgaaaccccg

SEQ ID NO: 10058527 - DNA, 22 bp, Homo sapiens
tcatttatgcaggaatggcata

SEQ ID NO: 10058528 - DNA, 22 bp, Homo sapiens
tagcaagatccttccctggcgt

SEQ ID NO: 10058529 - DNA, 22 bp, Homo sapiens
tagcaagatgatgaattattca

SEQ ID NO: 10058530 - DNA, 22 bp, Homo sapiens
gaaaatgagcctcagctacatt

SEQ ID NO: 10058531 - DNA, 22 bp, Homo sapiens
atgaggcatctgcagtcactag

SEQ ID NO: 10058532 - DNA, 22 bp, Homo sapiens
gctccaggctgctctgtcccat

SEQ ID NO: 10058533 - DNA, 22 bp, Homo sapiens
gctccaggcgagctggaccaga

SEQ ID NO: 10058534 - DNA, 19 bp, Homo sapiens
ggatccagaggatctgcca

SEQ ID NO: 10058535 - DNA, 22 bp, Homo sapiens
ggatccagaggtgaagatggga

SEQ ID NO: 10058536 - DNA, 22 bp, Homo sapiens
ggatccagtccagggctgtgtg

SEQ ID NO: 10058537 - DNA, 22 bp, Homo sapiens
cagaaatagacaatggcagtgg

SEQ ID NO: 10058538 - DNA, 22 bp, Homo sapiens
aggctgaggatccctgtgttct

SEQ ID NO: 10058539 - DNA, 22 bp, Homo sapiens
aggctgagctgacctggtttgg

SEQ ID NO: 10058540 - DNA, 19 bp, Homo sapiens
ccaaaggaagtttccctcc

SEQ ID NO: 10058541 - DNA, 22 bp, Homo sapiens
ccaaaggatgtccctgtgtttt

SEQ ID NO: 10058542 - DNA, 22 bp, Homo sapiens
aggcagaggaagggtggatttg

SEQ ID NO: 10058543 - DNA, 19 bp, Homo sapiens
aggcagaggcttggctagc

SEQ ID NO: 10058544 - DNA, 22 bp, Homo sapiens
aggatccagccagggtggagtt

SEQ ID NO: 10058545 - DNA, 22 bp, Homo sapiens
atcacaaaggtctcagagcaca

SEQ ID NO: 10058546 - DNA, 22 bp, Homo sapiens
ctgtaatcccagctactcggga

SEQ ID NO: 10058547 - DNA, 22 bp, Homo sapiens
aggtaatttctccaaacatgct

SEQ ID NO: 10058548 - DNA, 22 bp, Homo sapiens
aggtaactgtggctaggtaact

SEQ ID NO: 10058549 - DNA, 22 bp, Homo sapiens
aggtaactggctaactgaacga

SEQ ID NO: 10058550 - DNA, 22 bp, Homo sapiens
cctgaggttatccatctacctg

SEQ ID NO: 10058551 - DNA, 22 bp, Homo sapiens
actgcactcctgcctgggtaac

SEQ ID NO: 10058552 - DNA, 22 bp, Homo sapiens
actgcactccagcctgggtgat

SEQ ID NO: 10058553 - DNA, 22 bp, Homo sapiens
actgcacttcaccctgggtgac

SEQ ID NO: 10058554 - DNA, 22 bp, Homo sapiens
acttccttccaaacattcattt

SEQ ID NO: 10058555 - DNA, 22 bp, Homo sapiens
atacaaaatatatactggagac

SEQ ID NO: 10058556 - DNA, 22 bp, Homo sapiens
agagagttgaggaagcaacact

SEQ ID NO: 10058557 - DNA, 22 bp, Homo sapiens
agacctggagtgaagagttccc

SEQ ID NO: 10058558 - DNA, 22 bp, Homo sapiens
agacctggaagttcaagagaaa

SEQ ID NO: 10058559 - DNA, 22 bp, Homo sapiens
agaatattcatctgtattctta

SEQ ID NO: 10058560 - DNA, 22 bp, Homo sapiens
caaagcaagggctgaagactcc

SEQ ID NO: 10058561 - DNA, 22 bp, Homo sapiens
caaagcaaggctcagtttgaac

SEQ ID NO: 10058562 - DNA, 22 bp, Homo sapiens
agcctgggcaacaacacagcga

SEQ ID NO: 10058563 - DNA, 21 bp, Homo sapiens
aagtaaatcagagaaataacc

SEQ ID NO: 10058564 - DNA, 22 bp, Homo sapiens
acctgggtctggtgttgggacg

SEQ ID NO: 10058565 - DNA, 22 bp, Homo sapiens
aactaagttgcccagtccctgg

SEQ ID NO: 10058566 - DNA, 22 bp, Homo sapiens
aacaacagctgctaaagagttg

SEQ ID NO: 10058567 - DNA, 22 bp, Homo sapiens
aagcaaatgtgggtgcagaatt

SEQ ID NO: 10058568 - DNA, 22 bp, Homo sapiens
aagcaaattctggaggtgaggt

SEQ ID NO: 10058569 - DNA, 22 bp, Homo sapiens
aagaatgagctcaaagatctta

SEQ ID NO: 10058570 - DNA, 22 bp, Homo sapiens
aaagaagcataggctagacttc

SEQ ID NO: 10058571 - DNA, 22 bp, Homo sapiens
aaatagaaaccaacaaggtcag

SEQ ID NO: 10058572 - DNA, 22 bp, Homo sapiens
aaatagaattggaagcagagtt

SEQ ID NO: 10058573 - DNA, 22 bp, Homo sapiens
ggatggcatgttgggctctgtt

SEQ ID NO: 10058574 - DNA, 20 bp, Homo sapiens
ggcatgagatgtgagggagg

SEQ ID NO: 10058575 - DNA, 21 bp, Homo sapiens
ggcatgagggcagtgagcaga

SEQ ID NO: 10058576 - DNA, 22 bp, Homo sapiens
gccttctgatatctcttggcat

SEQ ID NO: 10058577 - DNA, 22 bp, Homo sapiens
gccttctgatcgctggactgac

SEQ ID NO: 10058578 - DNA, 22 bp, Homo sapiens
gccttctgtgctcctggccttt

SEQ ID NO: 10058579 - DNA, 22 bp, Homo sapiens
gccttctgattgctggactgac

SEQ ID NO: 10058580 - DNA, 16 bp, Homo sapiens
gctgggagggagaggt

SEQ ID NO: 10058581 - DNA, 22 bp, Homo sapiens
gcataaacttaagattttgttt

SEQ ID NO: 10058582 - DNA, 22 bp, Homo sapiens
gcataaactccaaaaggcaggg

SEQ ID NO: 10058583 - DNA, 18 bp, Homo sapiens
tcccttctcccttgcctc

SEQ ID NO: 10058584 - DNA, 22 bp, Homo sapiens
tccaggaggaggaaggctgcca

SEQ ID NO: 10058585 - DNA, 22 bp, Homo sapiens
tccacgctgtgtgaccttgggc

SEQ ID NO: 10058586 - DNA, 22 bp, Homo sapiens
taagcaagtggtagaaggacaa

SEQ ID NO: 10058587 - DNA, 22 bp, Homo sapiens
tactgcactccagcctgggtga

SEQ ID NO: 10058588 - DNA, 22 bp, Homo sapiens
tacgcctgtaatcccagcactt

SEQ ID NO: 10058589 - DNA, 22 bp, Homo sapiens
tagagcaatgctctactccttg

SEQ ID NO: 10058590 - DNA, 22 bp, Homo sapiens
tagcaagaagggagatggggtt

SEQ ID NO: 10058591 - DNA, 22 bp, Homo sapiens
tagcaagacaacttttctcagt

SEQ ID NO: 10058592 - DNA, 22 bp, Homo sapiens
tagcaagaggtgaaggtttcat

SEQ ID NO: 10058593 - DNA, 22 bp, Homo sapiens
tagtatagattgaagcagatca

SEQ ID NO: 10058594 - DNA, 22 bp, Homo sapiens
tatgcatagtgatttagaacag

SEQ ID NO: 10058595 - DNA, 22 bp, Homo sapiens
tattcatattgtaaaagaagtg

SEQ ID NO: 10058596 - DNA, 22 bp, Homo sapiens
cgcaccactgaattccagcctg

SEQ ID NO: 10058597 - DNA, 17 bp, Homo sapiens
tgttttcattcattgct

SEQ ID NO: 10058598 - DNA, 22 bp, Homo sapiens
ttcagtttcgttatctatgaga

SEQ ID NO: 10058599 - DNA, 22 bp, Homo sapiens
ctgcgttctgcctggcggccta

SEQ ID NO: 10058600 - DNA, 22 bp, Homo sapiens
ctcccttccaatgactatgctt

SEQ ID NO: 10058601 - DNA, 22 bp, Homo sapiens
cttcctttgctgttcggaggtt

SEQ ID NO: 10058602 - DNA, 22 bp, Homo sapiens
cttcatttccatccaactggga

SEQ ID NO: 10058603 - DNA, 22 bp, Homo sapiens
cttttccaaagtccatctggtc

SEQ ID NO: 10058604 - DNA, 22 bp, Homo sapiens
gaggctgagtagctttgtgctc

SEQ ID NO: 10058605 - DNA, 22 bp, Homo sapiens
gaggctgaacaggttctcatga

SEQ ID NO: 10058606 - DNA, 20 bp, Homo sapiens
gaggctgaagtgtttttgct

SEQ ID NO: 10058607 - DNA, 22 bp, Homo sapiens
gaggctgacggcaccatcttct

SEQ ID NO: 10058608 - DNA, 22 bp, Homo sapiens
gagaaagatggaatcttacagg

SEQ ID NO: 10058609 - DNA, 22 bp, Homo sapiens
tagaaagacagaggttttgtct

SEQ ID NO: 10058610 - DNA, 22 bp, Homo sapiens
tagaaagagcatagtattataa

SEQ ID NO: 10058611 - DNA, 19 bp, Homo sapiens
cattttcccatcatccttt

SEQ ID NO: 10058612 - DNA, 22 bp, Homo sapiens
cattttccacaggcctatttcc

SEQ ID NO: 10058613 - DNA, 22 bp, Homo sapiens
tgaaacaaatttggaaaatcta

SEQ ID NO: 10058614 - DNA, 22 bp, Homo sapiens
tgcactccaggctgggtgacag

SEQ ID NO: 10058615 - DNA, 22 bp, Homo sapiens
ttcatattgcttccgtggagtg

SEQ ID NO: 10058616 - DNA, 22 bp, Homo sapiens
ttcatattatgatttgaaatgc

SEQ ID NO: 10058617 - DNA, 22 bp, Homo sapiens
ttcatattcaaatactctgctt

SEQ ID NO: 10058618 - DNA, 22 bp, Homo sapiens
tttcatattattccttgagtct

SEQ ID NO: 10058619 - DNA, 21 bp, Homo sapiens
ccataaacagatggtaactgt

SEQ ID NO: 10058620 - DNA, 22 bp, Homo sapiens
aggcatgactttggctgaagaa

SEQ ID NO: 10058621 - DNA, 22 bp, Homo sapiens
caggaggtgaaggagaaccagt

SEQ ID NO: 10058622 - DNA, 22 bp, Homo sapiens
aggaacctgagtctgatcattt

SEQ ID NO: 10058623 - DNA, 20 bp, Homo sapiens
catgccatgtctactgaggc

SEQ ID NO: 10058624 - DNA, 22 bp, Homo sapiens
cgaggcagggaagctgcaaaag

SEQ ID NO: 10058625 - DNA, 22 bp, Homo sapiens
atcatgttgctcaaaattaaac

SEQ ID NO: 10058626 - DNA, 22 bp, Homo sapiens
atcatgttttaattagcaaact

SEQ ID NO: 10058627 - DNA, 22 bp, Homo sapiens
gagagctgtgttcattctacca

SEQ ID NO: 10058628 - DNA, 19 bp, Homo sapiens
atgtacccagtgtcaatcc

SEQ ID NO: 10058629 - DNA, 22 bp, Homo sapiens
gaaagcaagttgactgcagaat

SEQ ID NO: 10058630 - DNA, 22 bp, Homo sapiens
gaaagcaatttgtgtaatctgt

SEQ ID NO: 10058631 - DNA, 22 bp, Homo sapiens
caaaactgtctagagagagaag

SEQ ID NO: 10058632 - DNA, 20 bp, Homo sapiens
attcccttctccctgtttga

SEQ ID NO: 10058633 - DNA, 22 bp, Homo sapiens
gtatcatatgcatcaggcttgc

SEQ ID NO: 10058634 - DNA, 22 bp, Homo sapiens
agacggattacctgaggtcagg

SEQ ID NO: 10058635 - DNA, 22 bp, Homo sapiens
cagaagagatgaaatagtatta

SEQ ID NO: 10058636 - DNA, 22 bp, Homo sapiens
agccctaaattatctttatttt

SEQ ID NO: 10058637 - DNA, 22 bp, Homo sapiens
acctgggttgctggcgtgaggg

SEQ ID NO: 10058638 - DNA, 22 bp, Homo sapiens
atatcctttactgtgtcacaga

SEQ ID NO: 10058639 - DNA, 22 bp, Homo sapiens
aagatcaggcgtggaaaacact

SEQ ID NO: 10058640 - DNA, 22 bp, Homo sapiens
aagagggctgcaatcttattgc

SEQ ID NO: 10058641 - DNA, 22 bp, Homo sapiens
aaagcaagtctctacaaagtac

SEQ ID NO: 10058642 - DNA, 22 bp, Homo sapiens
aaagcaagatgcatccgtcaag

SEQ ID NO: 10058643 - DNA, 23 bp, Homo sapiens
aaagcaaggaattggcaacagag

SEQ ID NO: 10058644 - DNA, 22 bp, Homo sapiens
aacccgggaggcagaggttgtg

SEQ ID NO: 10058645 - DNA, 22 bp, Homo sapiens
aaagactgcaaaaacgcacaga

SEQ ID NO: 10058646 - DNA, 22 bp, Homo sapiens
aaagaaatacctttctcagctt

SEQ ID NO: 10058647 - DNA, 22 bp, Homo sapiens
aagcaagaggaaatgtggacct

SEQ ID NO: 10058648 - DNA, 22 bp, Homo sapiens
aagcaattcagcaaacctagaa

SEQ ID NO: 10058649 - DNA, 22 bp, Homo sapiens
aagaaaagaaacctgaggcttt

SEQ ID NO: 10058650 - DNA, 22 bp, Homo sapiens
aattccctcaggggactccttt

SEQ ID NO: 10058651 - DNA, 22 bp, Homo sapiens
acacaaagttggatgacaaaat

SEQ ID NO: 10058652 - DNA, 22 bp, Homo sapiens
aagagcaacttggaaacactca

SEQ ID NO: 10058653 - DNA, 22 bp, Homo sapiens
aatagcaaacactggtaaagtt

SEQ ID NO: 10058654 - DNA, 22 bp, Homo sapiens
aactagcagctaagacataatt

SEQ ID NO: 10058655 - DNA, 22 bp, Homo sapiens
aacctgggcttgaacagtgcct

SEQ ID NO: 10058656 - DNA, 22 bp, Homo sapiens
aacccgggaggcggaggttgtg

SEQ ID NO: 10058657 - DNA, 22 bp, Homo sapiens
aatggcagaggcaaagatggta

SEQ ID NO: 10058658 - DNA, 22 bp, Homo sapiens
aattgaaaatattgtagaccat

SEQ ID NO: 10058659 - DNA, 22 bp, Homo sapiens
actgcactccagcctgggtgac

SEQ ID NO: 10058660 - DNA, 22 bp, Homo sapiens
actgcactccagcctgggtaac

SEQ ID NO: 10058661 - DNA, 22 bp, Homo sapiens
actgcactccaacctgggtgac

SEQ ID NO: 10058662 - DNA, 22 bp, Homo sapiens
agaaatgaaaccaaagcctaga

SEQ ID NO: 10058663 - DNA, 22 bp, Homo sapiens
agaaatgaagcaggagttatta

SEQ ID NO: 10058664 - DNA, 22 bp, Homo sapiens
agaaatgacacacatgagacat

SEQ ID NO: 10058665 - DNA, 22 bp, Homo sapiens
gggcggatcacctgaggtcagg

SEQ ID NO: 10058666 - DNA, 22 bp, Homo sapiens
gggcggatcatttgaggtcagg

SEQ ID NO: 10058667 - DNA, 22 bp, Homo sapiens
gtgggctgaggggacaccaagg

SEQ ID NO: 10058668 - DNA, 18 bp, Homo sapiens
gtcaggcatgaatctggg

SEQ ID NO: 10058669 - DNA, 22 bp, Homo sapiens
gtcaggcagtggaaattaaaaa

SEQ ID NO: 10058670 - DNA, 22 bp, Homo sapiens
ggtggcagcatggtcccagtgt

SEQ ID NO: 10058671 - DNA, 22 bp, Homo sapiens
gccataaaatgtggatgaggga

SEQ ID NO: 10058672 - DNA, 22 bp, Homo sapiens
gccataaatgaaggaaaggtat

SEQ ID NO: 10058673 - DNA, 22 bp, Homo sapiens
gcctgtcaattttgtgtacaat

SEQ ID NO: 10058674 - DNA, 22 bp, Homo sapiens
gcaaactggcaaacctgtctgt

SEQ ID NO: 10058675 - DNA, 22 bp, Homo sapiens
gcaaactgcattctatagcttg

SEQ ID NO: 10058676 - DNA, 22 bp, Homo sapiens
gcaaactgatttccaagtccgt

SEQ ID NO: 10058677 - DNA, 22 bp, Homo sapiens
gataaacactaaggtcgctgaa

SEQ ID NO: 10058678 - DNA, 22 bp, Homo sapiens
gatccagcttctacacagagct

SEQ ID NO: 10058679 - DNA, 22 bp, Homo sapiens
gaggcagaggttgttgcagtga

SEQ ID NO: 10058680 - DNA, 18 bp, Homo sapiens
gagagctgctacctagct

SEQ ID NO: 10058681 - DNA, 22 bp, Homo sapiens
ttcctttctctggactgcagcc

SEQ ID NO: 10058682 - DNA, 22 bp, Homo sapiens
ttccatttattcttgtccagat

SEQ ID NO: 10058683 - DNA, 22 bp, Homo sapiens
ttcccttctagttttgagagac

SEQ ID NO: 10058684 - DNA, 22 bp, Homo sapiens
ttcccttcaaggtggcctaaag

SEQ ID NO: 10058685 - DNA, 22 bp, Homo sapiens
ttcccttaaattatggcatcta

SEQ ID NO: 10058686 - DNA, 22 bp, Homo sapiens
ttgatacccaagtgttatgggt

SEQ ID NO: 10058687 - DNA, 22 bp, Homo sapiens
gtgtggaatggagtttttgccc

SEQ ID NO: 10058688 - DNA, 22 bp, Homo sapiens
gtgtggaaccaaataacctaaa

SEQ ID NO: 10058689 - DNA, 22 bp, Homo sapiens
caggcagaagaagtggaaggac

SEQ ID NO: 10058690 - DNA, 22 bp, Homo sapiens
catttattagttagttcgatgt

SEQ ID NO: 10058691 - DNA, 22 bp, Homo sapiens
tctgcgttgctcacgctgggag

SEQ ID NO: 10058692 - DNA, 22 bp, Homo sapiens
tcttgaattgtactcccataag

SEQ ID NO: 10058693 - DNA, 22 bp, Homo sapiens
tctcatttacttccacaggctg

SEQ ID NO: 10058694 - DNA, 22 bp, Homo sapiens
tccttctgaaaaatgcacacga

SEQ ID NO: 10058695 - DNA, 22 bp, Homo sapiens
tccttctggaggctctaagggg

SEQ ID NO: 10058696 - DNA, 20 bp, Homo sapiens
tccttctgaggtgaggagga

SEQ ID NO: 10058697 - DNA, 22 bp, Homo sapiens
tccttctgtagtccctgtccct

SEQ ID NO: 10058698 - DNA, 22 bp, Homo sapiens
tcgcaccattgcactccagcca

SEQ ID NO: 10058699 - DNA, 22 bp, Homo sapiens
tcctttccctttccatcctggc

SEQ ID NO: 10058700 - DNA, 22 bp, Homo sapiens
tcctttccatgcttctagaggc

SEQ ID NO: 10058701 - DNA, 22 bp, Homo sapiens
tcctttcttcttctgcccatgg

SEQ ID NO: 10058702 - DNA, 18 bp, Homo sapiens
tcctttctccctcatctt

SEQ ID NO: 10058703 - DNA, 22 bp, Homo sapiens
tcctttctgtctttactctgga

SEQ ID NO: 10058704 - DNA, 19 bp, Homo sapiens
tcctttctgttcctgagat

SEQ ID NO: 10058705 - DNA, 18 bp, Homo sapiens
tgagaggctattttttgc

SEQ ID NO: 10058706 - DNA, 22 bp, Homo sapiens
tgagccaagttcacaccattgc

SEQ ID NO: 10058707 - DNA, 22 bp, Homo sapiens
tgaggctggatgggatgcctcc

SEQ ID NO: 10058708 - DNA, 21 bp, Homo sapiens
tgaggcaggggtgcttttgtc

SEQ ID NO: 10058709 - DNA, 22 bp, Homo sapiens
tgaggcaagtactttccctttt

SEQ ID NO: 10058710 - DNA, 21 bp, Homo sapiens
tgcagctgacactggtatgcc

SEQ ID NO: 10058711 - DNA, 22 bp, Homo sapiens
tgtgtactcaattgagccattt

SEQ ID NO: 10058712 - DNA, 22 bp, Homo sapiens
ttccagctaactcacatccctt

SEQ ID NO: 10058713 - DNA, 22 bp, Homo sapiens
tgtagcaagagcaatccattgt

SEQ ID NO: 10058714 - DNA, 17 bp, Homo sapiens
tgtatttatcatgtcag

SEQ ID NO: 10058715 - DNA, 19 bp, Homo sapiens
tggaggcaagacatggagg

SEQ ID NO: 10058716 - DNA, 22 bp, Homo sapiens
tggaggcaggtggaggagtgaa

SEQ ID NO: 10058717 - DNA, 22 bp, Homo sapiens
tggaggcagatacactgtaaaa

SEQ ID NO: 10058718 - DNA, 22 bp, Homo sapiens
tggaaaaactgagacttagaca

SEQ ID NO: 10058719 - DNA, 22 bp, Homo sapiens
tgctggagaagctcctgggact

SEQ ID NO: 10058720 - DNA, 18 bp, Homo sapiens
tggcataaaatcagagtc

SEQ ID NO: 10058721 - DNA, 22 bp, Homo sapiens
tggcagagtctctcctttccag

SEQ ID NO: 10058722 - DNA, 22 bp, Homo sapiens
tggcagagtgcagaagaggcat

SEQ ID NO: 10058723 - DNA, 22 bp, Homo sapiens
tggcagagtggaccatactcaa

SEQ ID NO: 10058724 - DNA, 22 bp, Homo sapiens
tggcagagcccagactccagtc

SEQ ID NO: 10058725 - DNA, 22 bp, Homo sapiens
tggattcaaatttcagctctgt

SEQ ID NO: 10058726 - DNA, 22 bp, Homo sapiens
actctgctgtctgatggcagga

SEQ ID NO: 10058727 - DNA, 22 bp, Homo sapiens
actctgctgtttactctctata

SEQ ID NO: 10058728 - DNA, 22 bp, Homo sapiens
actctgctgataggtcctcaga

SEQ ID NO: 10058729 - DNA, 22 bp, Homo sapiens
actcagaagatgtgggtagata

SEQ ID NO: 10058730 - DNA, 22 bp, Homo sapiens
actatacagtatgtacgtgcac

SEQ ID NO: 10058731 - DNA, 22 bp, Homo sapiens
aagccaaaggctccagtgacct

SEQ ID NO: 10058732 - DNA, 22 bp, Homo sapiens
agaggctctttgcttgttctta

SEQ ID NO: 10058733 - DNA, 22 bp, Homo sapiens
agaggctctgccgcctcaggta

SEQ ID NO: 10058734 - DNA, 22 bp, Homo sapiens
agaggctcttgcccttcccaca

SEQ ID NO: 10058735 - DNA, 22 bp, Homo sapiens
acaaccatgtcagttcaaacca

SEQ ID NO: 10058736 - DNA, 22 bp, Homo sapiens
acaacacagcaaaaccccatct

SEQ ID NO: 10058737 - DNA, 22 bp, Homo sapiens
acaacacagctttcctcaagtt

SEQ ID NO: 10058738 - DNA, 22 bp, Homo sapiens
acaacacatgtgtatatgtgtg

SEQ ID NO: 10058739 - DNA, 23 bp, Homo sapiens
agaagcagcttctggagtatcgg

SEQ ID NO: 10058740 - DNA, 23 bp, Homo sapiens
aatggtcttcctccacccctctg

SEQ ID NO: 10058741 - DNA, 22 bp, Homo sapiens
agcctctctccagcttggcaga

SEQ ID NO: 10058742 - DNA, 22 bp, Homo sapiens
agcctctgactgtcagcaaggt

SEQ ID NO: 10058743 - DNA, 22 bp, Homo sapiens
acactgaagagcactttcaaag

SEQ ID NO: 10058744 - DNA, 22 bp, Homo sapiens
acacagaagatctcttaatgct

SEQ ID NO: 10058745 - DNA, 22 bp, Homo sapiens
aacctggagcaccctcatatct

SEQ ID NO: 10058746 - DNA, 22 bp, Homo sapiens
aatgacaagacatagtctctga

SEQ ID NO: 10058747 - DNA, 22 bp, Homo sapiens
aacatctgatcgaacagtgcca

SEQ ID NO: 10058748 - DNA, 22 bp, Homo sapiens
aacacagctaatttctgtcaat

SEQ ID NO: 10058749 - DNA, 22 bp, Homo sapiens
aagagcaacttggaaacactca

SEQ ID NO: 10058750 - DNA, 22 bp, Homo sapiens
aagagcagcctccaggggtgga

SEQ ID NO: 10058751 - DNA, 22 bp, Homo sapiens
aagatgttaaatctgtagaatt

SEQ ID NO: 10058752 - DNA, 22 bp, Homo sapiens
aagagcaggctgtcaatggggc

SEQ ID NO: 10058753 - DNA, 22 bp, Homo sapiens
aaactgtgaagcaagtacaagg

SEQ ID NO: 10058754 - DNA, 21 bp, Homo sapiens
aaagaacaggcagatgttctt

SEQ ID NO: 10058755 - DNA, 22 bp, Homo sapiens
aaagacatgacacattggagag

SEQ ID NO: 10058756 - DNA, 20 bp, Homo sapiens
aaaatatgtataactcttct

SEQ ID NO: 10058757 - DNA, 22 bp, Homo sapiens
aaaaatacttcacttctgggtg

SEQ ID NO: 10058758 - DNA, 22 bp, Homo sapiens
aacatacagtgagcagtggact

SEQ ID NO: 10058759 - DNA, 22 bp, Homo sapiens
aaagcccccctgatctgagatg

SEQ ID NO: 10058760 - DNA, 23 bp, Homo sapiens
aacacttgcatgaacagctacac

SEQ ID NO: 10058761 - DNA, 22 bp, Homo sapiens
aaagcagaactgagagagctgg

SEQ ID NO: 10058762 - DNA, 22 bp, Homo sapiens
aagcctaggcctactctggttt

SEQ ID NO: 10058763 - DNA, 22 bp, Homo sapiens
actgtcatcttgtaagcaatgt

SEQ ID NO: 10058764 - DNA, 21 bp, Homo sapiens
agtttcctcaactgcagaagg

SEQ ID NO: 10058765 - DNA, 22 bp, Homo sapiens
actgtaaaatgagatatgtata

SEQ ID NO: 10058766 - DNA, 22 bp, Homo sapiens
actgtaaagaagtaagtatggg

SEQ ID NO: 10058767 - DNA, 19 bp, Homo sapiens
acttcaaatcttagagaaa

SEQ ID NO: 10058768 - DNA, 22 bp, Homo sapiens
agggcttgttaacatagagatt

SEQ ID NO: 10058769 - DNA, 22 bp, Homo sapiens
actattcaagtgctcattcaga

SEQ ID NO: 10058770 - DNA, 22 bp, Homo sapiens
actaaagtgttggagaatgagg

SEQ ID NO: 10058771 - DNA, 22 bp, Homo sapiens
actgaagtccacacatgtagga

SEQ ID NO: 10058772 - DNA, 21 bp, Homo sapiens
actgcaaacagcagagactga

SEQ ID NO: 10058773 - DNA, 22 bp, Homo sapiens
actgaaagtccagcatggtaca

SEQ ID NO: 10058774 - DNA, 22 bp, Homo sapiens
accctcaacaaattcactctat

SEQ ID NO: 10058775 - DNA, 22 bp, Homo sapiens
aggcgcagcacgtgagagttgg

SEQ ID NO: 10058776 - DNA, 22 bp, Homo sapiens
acatttatataactcactagga

SEQ ID NO: 10058777 - DNA, 22 bp, Homo sapiens
acagctcctaacaaaggctctc

SEQ ID NO: 10058778 - DNA, 20 bp, Homo sapiens
agctgccttcattttctaga

SEQ ID NO: 10058779 - DNA, 22 bp, Homo sapiens
agctgccagcaagtttcaaaca

SEQ ID NO: 10058780 - DNA, 22 bp, Homo sapiens
agctgccagcatcccggaaggg

SEQ ID NO: 10058781 - DNA, 22 bp, Homo sapiens
agctgccatcagcctttggatg

SEQ ID NO: 10058782 - DNA, 22 bp, Homo sapiens
agctgccatccgaggtgtcaga

SEQ ID NO: 10058783 - DNA, 22 bp, Homo sapiens
agctgccagggactgggcatgg

SEQ ID NO: 10058784 - DNA, 22 bp, Homo sapiens
acagtaagcggggttggagggc

SEQ ID NO: 10058785 - DNA, 22 bp, Homo sapiens
agctcccagtctcctctccatg

SEQ ID NO: 10058786 - DNA, 22 bp, Homo sapiens
agaaggctgagactgggatgaa

SEQ ID NO: 10058787 - DNA, 22 bp, Homo sapiens
agaagagagtcctaccccatac

SEQ ID NO: 10058788 - DNA, 22 bp, Homo sapiens
agacagtatgatatatgaatac

SEQ ID NO: 10058789 - DNA, 22 bp, Homo sapiens
agacacataggaccacactgtg

SEQ ID NO: 10058790 - DNA, 22 bp, Homo sapiens
atttccaaggtaattttgagta

SEQ ID NO: 10058791 - DNA, 22 bp, Homo sapiens
attcttcattgttgattcatgt

SEQ ID NO: 10058792 - DNA, 22 bp, Homo sapiens
attcttcatgttgaagctgtca

SEQ ID NO: 10058793 - DNA, 22 bp, Homo sapiens
attacagtggacagctatgcac

SEQ ID NO: 10058794 - DNA, 22 bp, Homo sapiens
gggtgccttggtgtgctgtagg

SEQ ID NO: 10058795 - DNA, 22 bp, Homo sapiens
cagaagggacagggtttgtaga

SEQ ID NO: 10058796 - DNA, 22 bp, Homo sapiens
caagacaagatctaagcatgct

SEQ ID NO: 10058797 - DNA, 22 bp, Homo sapiens
cacacatattgtccctagtgtg

SEQ ID NO: 10058798 - DNA, 22 bp, Homo sapiens
gcttgggagaggcttcctcttt

SEQ ID NO: 10058799 - DNA, 22 bp, Homo sapiens
gcttctgacagcacctgaactt

SEQ ID NO: 10058800 - DNA, 22 bp, Homo sapiens
gcttctgaggaaggctcagcct

SEQ ID NO: 10058801 - DNA, 22 bp, Homo sapiens
cactgaaggacagtaggaaggg

SEQ ID NO: 10058802 - DNA, 22 bp, Homo sapiens
caccatttaagaaagccaaatt

SEQ ID NO: 10058803 - DNA, 22 bp, Homo sapiens
ggatgttctggggttctcttgt

SEQ ID NO: 10058804 - DNA, 22 bp, Homo sapiens
attctacacaaagcaagaagac

SEQ ID NO: 10058805 - DNA, 22 bp, Homo sapiens
attcttcagaatatctggcact

SEQ ID NO: 10058806 - DNA, 22 bp, Homo sapiens
attcttcaaagagtgtcaaagt

SEQ ID NO: 10058807 - DNA, 22 bp, Homo sapiens
atgttttcctgggagagcactc

SEQ ID NO: 10058808 - DNA, 22 bp, Homo sapiens
caaactattgttcacaagacaa

SEQ ID NO: 10058809 - DNA, 22 bp, Homo sapiens
gcctggagctcggctgagggcg

SEQ ID NO: 10058810 - DNA, 22 bp, Homo sapiens
gcctggagctcatgtgggcatt

SEQ ID NO: 10058811 - DNA, 22 bp, Homo sapiens
gcctggagctactggacactga

SEQ ID NO: 10058812 - DNA, 22 bp, Homo sapiens
atttccttgcaagtttctgtaa

SEQ ID NO: 10058813 - DNA, 22 bp, Homo sapiens
atttacacttggtttactagag

SEQ ID NO: 10058814 - DNA, 22 bp, Homo sapiens
gaaagcaatttgtgtaatctgt

SEQ ID NO: 10058815 - DNA, 22 bp, Homo sapiens
atgcaaagcaccacactaagat

SEQ ID NO: 10058816 - DNA, 22 bp, Homo sapiens
cttttcagagctgagatcaccg

SEQ ID NO: 10058817 - DNA, 22 bp, Homo sapiens
cttgctcattaagtagctcaca

SEQ ID NO: 10058818 - DNA, 22 bp, Homo sapiens
cttgatctacatagtgaaaccc

SEQ ID NO: 10058819 - DNA, 22 bp, Homo sapiens
atgtctttcaaattctgcctag

SEQ ID NO: 10058820 - DNA, 22 bp, Homo sapiens
atgtgtcatttttctgtgcata

SEQ ID NO: 10058821 - DNA, 22 bp, Homo sapiens
atggagctgtgtgaatattcat

SEQ ID NO: 10058822 - DNA, 19 bp, Homo sapiens
atggaagctgggatcaatg

SEQ ID NO: 10058823 - DNA, 22 bp, Homo sapiens
atccaaacctggacatgagtgg

SEQ ID NO: 10058824 - DNA, 22 bp, Homo sapiens
atccaaacatgtaccacactaa

SEQ ID NO: 10058825 - DNA, 22 bp, Homo sapiens
atccaaactatgactagtgttc

SEQ ID NO: 10058826 - DNA, 22 bp, Homo sapiens
atcatttttaagagactcttct

SEQ ID NO: 10058827 - DNA, 22 bp, Homo sapiens
atatatcatgagtaaaacttga

SEQ ID NO: 10058828 - DNA, 22 bp, Homo sapiens
atacaagttaatgagaatgaca

SEQ ID NO: 10058829 - DNA, 22 bp, Homo sapiens
atacttctcatgggctctgagc

SEQ ID NO: 10058830 - DNA, 18 bp, Homo sapiens
atacaagcagcagagatt

SEQ ID NO: 10058831 - DNA, 22 bp, Homo sapiens
ctctgtcaggctgcagatgctc

SEQ ID NO: 10058832 - DNA, 22 bp, Homo sapiens
cgggttcacgccattctcctgc

SEQ ID NO: 10058833 - DNA, 22 bp, Homo sapiens
ctcagaagaacaaaggctctac

SEQ ID NO: 10058834 - DNA, 22 bp, Homo sapiens
ctcagaagctctgctcctttgc

SEQ ID NO: 10058835 - DNA, 22 bp, Homo sapiens
ctcagacatttgtagaaagtgc

SEQ ID NO: 10058836 - DNA, 22 bp, Homo sapiens
ctccagaaattcaacagcaaat

SEQ ID NO: 10058837 - DNA, 22 bp, Homo sapiens
aggaggagcagctttttgtctc

SEQ ID NO: 10058838 - DNA, 22 bp, Homo sapiens
aggaactctgtctccagagttg

SEQ ID NO: 10058839 - DNA, 22 bp, Homo sapiens
aggaactgatttataactttag

SEQ ID NO: 10058840 - DNA, 22 bp, Homo sapiens
agcttgtgtttttctaagtatc

SEQ ID NO: 10058841 - DNA, 22 bp, Homo sapiens
agctctgacattgattctcagc

SEQ ID NO: 10058842 - DNA, 22 bp, Homo sapiens
cagcttttggcaggatgaccag

SEQ ID NO: 10058843 - DNA, 20 bp, Homo sapiens
aggctctgccattgtccctg

SEQ ID NO: 10058844 - DNA, 22 bp, Homo sapiens
tctgcctgaaccactcttggag

SEQ ID NO: 10058845 - DNA, 22 bp, Homo sapiens
tctgcctgagaagtggggtgcc

SEQ ID NO: 10058846 - DNA, 22 bp, Homo sapiens
tctgaggagtgaccctcttgca

SEQ ID NO: 10058847 - DNA, 22 bp, Homo sapiens
tctgaggacagtgctgtgcctg

SEQ ID NO: 10058848 - DNA, 18 bp, Homo sapiens
ccacagcagagttcttac

SEQ ID NO: 10058849 - DNA, 22 bp, Homo sapiens
tctccagtctcaagacattgag

SEQ ID NO: 10058850 - DNA, 22 bp, Homo sapiens
tatggatgagttcctgaggagt

SEQ ID NO: 10058851 - DNA, 22 bp, Homo sapiens
tatggatgtttatctacaggct

SEQ ID NO: 10058852 - DNA, 22 bp, Homo sapiens
tatggatggaaagggccaagct

SEQ ID NO: 10058853 - DNA, 22 bp, Homo sapiens
catgtcttaggaaagcagagga

SEQ ID NO: 10058854 - DNA, 22 bp, Homo sapiens
gttttcctgttgagtagtattc

SEQ ID NO: 10058855 - DNA, 22 bp, Homo sapiens
caggagcaaatccaaaagaatt

SEQ ID NO: 10058856 - DNA, 22 bp, Homo sapiens
gtgtctttattcctctatgttt

SEQ ID NO: 10058857 - DNA, 17 bp, Homo sapiens
gtgtctttgctgttgtg

SEQ ID NO: 10058858 - DNA, 22 bp, Homo sapiens
cagctgctctggtggtctctcc

SEQ ID NO: 10058859 - DNA, 22 bp, Homo sapiens
cagctgccacttgctctcggct

SEQ ID NO: 10058860 - DNA, 20 bp, Homo sapiens
cagctgcctggctctgggat

SEQ ID NO: 10058861 - DNA, 22 bp, Homo sapiens
gttcacagctgggacaagactg

SEQ ID NO: 10058862 - DNA, 22 bp, Homo sapiens
tttaaaaaactagtctgagtct

SEQ ID NO: 10058863 - DNA, 22 bp, Homo sapiens
tttagacatagctgaaatcatt

SEQ ID NO: 10058864 - DNA, 22 bp, Homo sapiens
ctctccaggagagcactttgag

SEQ ID NO: 10058865 - DNA, 22 bp, Homo sapiens
ctctccagaattattactatta

SEQ ID NO: 10058866 - DNA, 22 bp, Homo sapiens
ctctccagccacagaagctgct

SEQ ID NO: 10058867 - DNA, 22 bp, Homo sapiens
ctaaggatgcatatgttttgtt

SEQ ID NO: 10058868 - DNA, 22 bp, Homo sapiens
ttccttctaatattctgcctgt

SEQ ID NO: 10058869 - DNA, 22 bp, Homo sapiens
ctaataacatgaactactttct

SEQ ID NO: 10058870 - DNA, 22 bp, Homo sapiens
ttcagaaaggataattggaagg

SEQ ID NO: 10058871 - DNA, 22 bp, Homo sapiens
ttcagaaaaagaccattgcaat

SEQ ID NO: 10058872 - DNA, 22 bp, Homo sapiens
ttccaaactcatagtatggtgt

SEQ ID NO: 10058873 - DNA, 22 bp, Homo sapiens
ttcagaaaggttaatctggatt

SEQ ID NO: 10058874 - DNA, 22 bp, Homo sapiens
ttccttttcttaaacatatgtg

SEQ ID NO: 10058875 - DNA, 22 bp, Homo sapiens
ttccttttctcacggggatcca

SEQ ID NO: 10058876 - DNA, 22 bp, Homo sapiens
ttccttttcttatgcatcatta

SEQ ID NO: 10058877 - DNA, 22 bp, Homo sapiens
ttccttttcttctaccacatgt

SEQ ID NO: 10058878 - DNA, 21 bp, Homo sapiens
ttcttcctaaatacagatctc

SEQ ID NO: 10058879 - DNA, 22 bp, Homo sapiens
ctgaggagaaagatggtccaag

SEQ ID NO: 10058880 - DNA, 22 bp, Homo sapiens
ctgaggagttggtgaataagcc

SEQ ID NO: 10058881 - DNA, 22 bp, Homo sapiens
ctgaggagtgggtgggcagtga

SEQ ID NO: 10058882 - DNA, 22 bp, Homo sapiens
ctgcttctaagaacctgcagct

SEQ ID NO: 10058883 - DNA, 22 bp, Homo sapiens
ctggctctaagtgtcagctccc

SEQ ID NO: 10058884 - DNA, 22 bp, Homo sapiens
cctggagagagaggccaactgc

SEQ ID NO: 10058885 - DNA, 22 bp, Homo sapiens
tggtggcttctgaggatggcga

SEQ ID NO: 10058886 - DNA, 22 bp, Homo sapiens
tgtattatcaagtaaatacatg

SEQ ID NO: 10058887 - DNA, 22 bp, Homo sapiens
tgtctctgtgcatttgtgcttc

SEQ ID NO: 10058888 - DNA, 22 bp, Homo sapiens
tgtgggaaatgggagtggaaga

SEQ ID NO: 10058889 - DNA, 22 bp, Homo sapiens
tgccacacagctgtatgaggga

SEQ ID NO: 10058890 - DNA, 22 bp, Homo sapiens
tgccacactcccctgctgcagt

SEQ ID NO: 10058891 - DNA, 22 bp, Homo sapiens
cctctctttcctacaccttgga

SEQ ID NO: 10058892 - DNA, 22 bp, Homo sapiens
cctcggaggcggaggctgcagt

SEQ ID NO: 10058893 - DNA, 22 bp, Homo sapiens
gaactgtcattggggacatcag

SEQ ID NO: 10058894 - DNA, 22 bp, Homo sapiens
gaagtgcaacctgaaatactag

SEQ ID NO: 10058895 - DNA, 22 bp, Homo sapiens
gaaggctctgatttcttgcaaa

SEQ ID NO: 10058896 - DNA, 22 bp, Homo sapiens
ctttgttcatgacatctgcttc

SEQ ID NO: 10058897 - DNA, 22 bp, Homo sapiens
gaactctctcatctgtcagttg

SEQ ID NO: 10058898 - DNA, 22 bp, Homo sapiens
cttcttttgaagggcgttgtgt

SEQ ID NO: 10058899 - DNA, 22 bp, Homo sapiens
cttcttttcatggcttgggaag

SEQ ID NO: 10058900 - DNA, 22 bp, Homo sapiens
gatcacaatttagactttttaa

SEQ ID NO: 10058901 - DNA, 22 bp, Homo sapiens
gatagaaaggtgttgaaatcca

SEQ ID NO: 10058902 - DNA, 22 bp, Homo sapiens
gatgttcttataccattgtggg

SEQ ID NO: 10058903 - DNA, 22 bp, Homo sapiens
gcctggagtactccttgaagtg

SEQ ID NO: 10058904 - DNA, 22 bp, Homo sapiens
gcctggagtagcatggcaagcc

SEQ ID NO: 10058905 - DNA, 22 bp, Homo sapiens
gcctggagggctctagagaggc

SEQ ID NO: 10058906 - DNA, 22 bp, Homo sapiens
gcctggaggggccagggtggta

SEQ ID NO: 10058907 - DNA, 20 bp, Homo sapiens
gcctggaggcaatgggaaga

SEQ ID NO: 10058908 - DNA, 22 bp, Homo sapiens
gcctgcttcacggacaggcctc

SEQ ID NO: 10058909 - DNA, 22 bp, Homo sapiens
gtatatatcggcactattttaa

SEQ ID NO: 10058910 - DNA, 22 bp, Homo sapiens
gtatgtgcaattcactgtgaga

SEQ ID NO: 10058911 - DNA, 22 bp, Homo sapiens
gtatgtgctcagtaagtacatg

SEQ ID NO: 10058912 - DNA, 22 bp, Homo sapiens
gtggacaggcaggctgtcgggg

SEQ ID NO: 10058913 - DNA, 22 bp, Homo sapiens
gtgtccttatttctgtctctca

SEQ ID NO: 10058914 - DNA, 22 bp, Homo sapiens
gtgtccttcattggaatctctc

SEQ ID NO: 10058915 - DNA, 22 bp, Homo sapiens
gtgtctctatctatgcctgaag

SEQ ID NO: 10058916 - DNA, 22 bp, Homo sapiens
gtgtccacggctgagaatgatt

SEQ ID NO: 10058917 - DNA, 22 bp, Homo sapiens
gttctgagtcctcctttgaagg

SEQ ID NO: 10058918 - DNA, 22 bp, Homo sapiens
gttctactttctgtgtctttga

SEQ ID NO: 10058919 - DNA, 22 bp, Homo sapiens
gttctaatttggggctccttag

SEQ ID NO: 10058920 - DNA, 19 bp, Homo sapiens
gttcaaacactgattcagc

SEQ ID NO: 10058921 - DNA, 22 bp, Homo sapiens
gtttaaataattaggggcctgt

SEQ ID NO: 10058922 - DNA, 22 bp, Homo sapiens
taaagcttgtattgcaatattt

SEQ ID NO: 10058923 - DNA, 22 bp, Homo sapiens
taaatactttacaggatgtctc

SEQ ID NO: 10058924 - DNA, 22 bp, Homo sapiens
taaaggccagggcctgagtgct

SEQ ID NO: 10058925 - DNA, 22 bp, Homo sapiens
ggaggtggaggttgcagtgagc

SEQ ID NO: 10058926 - DNA, 22 bp, Homo sapiens
gcttctgatgtcagacttctgg

SEQ ID NO: 10058927 - DNA, 22 bp, Homo sapiens
gcttagaagattgaccctggtt

SEQ ID NO: 10058928 - DNA, 22 bp, Homo sapiens
ggagaaggtggctcagcaaagg

SEQ ID NO: 10058929 - DNA, 22 bp, Homo sapiens
ggagacagcaggaagaaatatc

SEQ ID NO: 10058930 - DNA, 22 bp, Homo sapiens
tggatgtgagagcatcatgttc

SEQ ID NO: 10058931 - DNA, 22 bp, Homo sapiens
tggcaacatgtcgaagtgctgt

SEQ ID NO: 10058932 - DNA, 22 bp, Homo sapiens
tggcaacacctggaagacatgg

SEQ ID NO: 10058933 - DNA, 22 bp, Homo sapiens
tggctcagccagccctaggaac

SEQ ID NO: 10058934 - DNA, 22 bp, Homo sapiens
tggctcagaactacttctagtt

SEQ ID NO: 10058935 - DNA, 22 bp, Homo sapiens
tggctcagaaggctgccttcac

SEQ ID NO: 10058936 - DNA, 22 bp, Homo sapiens
tggctcagagcagggactctgg

SEQ ID NO: 10058937 - DNA, 22 bp, Homo sapiens
tgggaatacaagttattcacct

SEQ ID NO: 10058938 - DNA, 22 bp, Homo sapiens
tgggaactggggcattgtttct

SEQ ID NO: 10058939 - DNA, 22 bp, Homo sapiens
tgctggctgttctagggaggcc

SEQ ID NO: 10058940 - DNA, 22 bp, Homo sapiens
tgcttctaatctactgcattag

SEQ ID NO: 10058941 - DNA, 22 bp, Homo sapiens
tgcttctgcaggagctcctgat

SEQ ID NO: 10058942 - DNA, 22 bp, Homo sapiens
tgcttctgattcatggttattg

SEQ ID NO: 10058943 - DNA, 22 bp, Homo sapiens
tgcttctgaagtggatgggtgc

SEQ ID NO: 10058944 - DNA, 22 bp, Homo sapiens
tgctcatgctggggacagatgt

SEQ ID NO: 10058945 - DNA, 22 bp, Homo sapiens
tgctaaataacttacatagtgg

SEQ ID NO: 10058946 - DNA, 22 bp, Homo sapiens
tgctatgtaaagctctgggttt

SEQ ID NO: 10058947 - DNA, 22 bp, Homo sapiens
tgctctaagaactctaggaatt

SEQ ID NO: 10058948 - DNA, 22 bp, Homo sapiens
tggaaaggtaggatttcaagac

SEQ ID NO: 10058949 - DNA, 22 bp, Homo sapiens
tgcttctgtttgtttctgtcat

SEQ ID NO: 10058950 - DNA, 22 bp, Homo sapiens
tgcttctgtttcattgatctta

SEQ ID NO: 10058951 - DNA, 17 bp, Homo sapiens
tgcttctgtattgctgg

SEQ ID NO: 10058952 - DNA, 22 bp, Homo sapiens
tgcttctgtattttgggcttga

SEQ ID NO: 10058953 - DNA, 22 bp, Homo sapiens
tgcttctgggcctggtgttccc

SEQ ID NO: 10058954 - DNA, 19 bp, Homo sapiens
tgcttctggggcttctcca

SEQ ID NO: 10058955 - DNA, 22 bp, Homo sapiens
tgcttctgctttacttggttca

SEQ ID NO: 10058956 - DNA, 19 bp, Homo sapiens
tgcttctggaaccatgatc

SEQ ID NO: 10058957 - DNA, 22 bp, Homo sapiens
tgcttctggagtaacagggtga

SEQ ID NO: 10058958 - DNA, 18 bp, Homo sapiens
tgctttctagcttcagat

SEQ ID NO: 10058959 - DNA, 22 bp, Homo sapiens
tgctttctcctgtctgaaagat

SEQ ID NO: 10058960 - DNA, 22 bp, Homo sapiens
tgctttctgctctggaaacagg

SEQ ID NO: 10058961 - DNA, 22 bp, Homo sapiens
tgctttctgtttttcatataat

SEQ ID NO: 10058962 - DNA, 17 bp, Homo sapiens
tgctttcttcctgccct

SEQ ID NO: 10058963 - DNA, 23 bp, Homo sapiens
tggacagcagcagcagtgtcacc

SEQ ID NO: 10058964 - DNA, 22 bp, Homo sapiens
tggacagcgaaagtgcctggga

SEQ ID NO: 10058965 - DNA, 22 bp, Homo sapiens
tggaagggggaagacagctctg

SEQ ID NO: 10058966 - DNA, 20 bp, Homo sapiens
tggaagaggagatgcctctg

SEQ ID NO: 10058967 - DNA, 22 bp, Homo sapiens
tggatggctggggaagagcagg

SEQ ID NO: 10058968 - DNA, 22 bp, Homo sapiens
tgtatttaattgtatcatcaca

SEQ ID NO: 10058969 - DNA, 21 bp, Homo sapiens
tgtatacacacatatatgtac

SEQ ID NO: 10058970 - DNA, 22 bp, Homo sapiens
tgtatacatttaactagataga

SEQ ID NO: 10058971 - DNA, 22 bp, Homo sapiens
tgtcattttaatcacctttcca

SEQ ID NO: 10058972 - DNA, 22 bp, Homo sapiens
tggtctaagagcctaactgctg

SEQ ID NO: 10058973 - DNA, 19 bp, Homo sapiens
tggtctaaatgtgtgcccc

SEQ ID NO: 10058974 - DNA, 22 bp, Homo sapiens
tgtaactgtggtctagggactg

SEQ ID NO: 10058975 - DNA, 22 bp, Homo sapiens
tgtacacatgcccacttgaagc

SEQ ID NO: 10058976 - DNA, 22 bp, Homo sapiens
tgtacacattaagctctttaga

SEQ ID NO: 10058977 - DNA, 22 bp, Homo sapiens
tgtacacacacgtgtgtatcta

SEQ ID NO: 10058978 - DNA, 22 bp, Homo sapiens
tgtacacaatgataaattatta

SEQ ID NO: 10058979 - DNA, 22 bp, Homo sapiens
tggggatcataaattgatggag

SEQ ID NO: 10058980 - DNA, 23 bp, Homo sapiens
ttcaggaaatgaatacagacaca

SEQ ID NO: 10058981 - DNA, 22 bp, Homo sapiens
ttacagaatgtgccatttggtc

SEQ ID NO: 10058982 - DNA, 22 bp, Homo sapiens
ttagggaaatatttatatactt

SEQ ID NO: 10058983 - DNA, 22 bp, Homo sapiens
tgttcttaacttttgtgtatat

SEQ ID NO: 10058984 - DNA, 22 bp, Homo sapiens
tgtttgctagggttggtattta

SEQ ID NO: 10058985 - DNA, 22 bp, Homo sapiens
tgtctgctacttggttctacca

SEQ ID NO: 10058986 - DNA, 22 bp, Homo sapiens
tgtctctgaactgggttttctt

SEQ ID NO: 10058987 - DNA, 22 bp, Homo sapiens
tgtctctgaggtgagggtcagc

SEQ ID NO: 10058988 - DNA, 22 bp, Homo sapiens
tgtgctcttctgttacttgtag

SEQ ID NO: 10058989 - DNA, 22 bp, Homo sapiens
tgtgacagatctctatacatga

SEQ ID NO: 10058990 - DNA, 22 bp, Homo sapiens
tgcagaatgtggacagtgggtt

SEQ ID NO: 10058991 - DNA, 22 bp, Homo sapiens
tgcacgtgtgagcattcacatg

SEQ ID NO: 10058992 - DNA, 23 bp, Homo sapiens
tgcatgtgaattcatacttgttt

SEQ ID NO: 10058993 - DNA, 22 bp, Homo sapiens
tgcatgtggacccctggtgcct

SEQ ID NO: 10058994 - DNA, 22 bp, Homo sapiens
tgcatgtgtcgggcctgtgcta

SEQ ID NO: 10058995 - DNA, 22 bp, Homo sapiens
tgcctaggctggagtgtagtgg

SEQ ID NO: 10058996 - DNA, 22 bp, Homo sapiens
tgcctctgggtgaccaaggagc

SEQ ID NO: 10058997 - DNA, 22 bp, Homo sapiens
tgcccagggtggagtgcagtgg

SEQ ID NO: 10058998 - DNA, 22 bp, Homo sapiens
tgcccaggctggagtgcagtgg

SEQ ID NO: 10058999 - DNA, 22 bp, Homo sapiens
tgcccaggctggaatgcagtgg

SEQ ID NO: 10059000 - DNA, 22 bp, Homo sapiens
tgcccaggctggagtgcagagg

SEQ ID NO: 10059001 - DNA, 22 bp, Homo sapiens
tgcccaggctggagtacagtgg

SEQ ID NO: 10059002 - DNA, 21 bp, Homo sapiens
tgaggctctgttgtgcctgca

SEQ ID NO: 10059003 - DNA, 22 bp, Homo sapiens
tgaggctccttgtagagagtgg

SEQ ID NO: 10059004 - DNA, 22 bp, Homo sapiens
tgagtatatacccagaagtgga

SEQ ID NO: 10059005 - DNA, 22 bp, Homo sapiens
tgagctgcattacagcctctgt

SEQ ID NO: 10059006 - DNA, 22 bp, Homo sapiens
tgagacagggtcttgctctgtt

SEQ ID NO: 10059007 - DNA, 22 bp, Homo sapiens
tgagacagcagattagcaatga

SEQ ID NO: 10059008 - DNA, 22 bp, Homo sapiens
tgacaaagaccttcaacaagat

SEQ ID NO: 10059009 - DNA, 22 bp, Homo sapiens
tgacagaactttttcacatctc

SEQ ID NO: 10059010 - DNA, 22 bp, Homo sapiens
tgacagtgaacaggttaccact

SEQ ID NO: 10059011 - DNA, 22 bp, Homo sapiens
tcttttagctctgcaaggaaag

SEQ ID NO: 10059012 - DNA, 22 bp, Homo sapiens
tcttttcattgagaacacactg

SEQ ID NO: 10059013 - DNA, 22 bp, Homo sapiens
tcttttcctcctcttgttggcc

SEQ ID NO: 10059014 - DNA, 22 bp, Homo sapiens
tcttttcaggaatggctctagt

SEQ ID NO: 10059015 - DNA, 22 bp, Homo sapiens
tctaaagtatgctaatatgtga

SEQ ID NO: 10059016 - DNA, 22 bp, Homo sapiens
tctaaagagagtgggtacatgt

SEQ ID NO: 10059017 - DNA, 22 bp, Homo sapiens
tctagacatcttggctgcaatt

SEQ ID NO: 10059018 - DNA, 22 bp, Homo sapiens
tctagacaatgcactgtaagga

SEQ ID NO: 10059019 - DNA, 19 bp, Homo sapiens
tctagacaccaaagttgtc

SEQ ID NO: 10059020 - DNA, 22 bp, Homo sapiens
tctacacatttgtaaaggcatt

SEQ ID NO: 10059021 - DNA, 19 bp, Homo sapiens
tctaacagctttcattcta

SEQ ID NO: 10059022 - DNA, 22 bp, Homo sapiens
tctcacagccatttctccctct

SEQ ID NO: 10059023 - DNA, 22 bp, Homo sapiens
tctcacagctctgctgcatgct

SEQ ID NO: 10059024 - DNA, 19 bp, Homo sapiens
tctcacagctctactatgt

SEQ ID NO: 10059025 - DNA, 22 bp, Homo sapiens
tctatttctgggtttgtgtggt

SEQ ID NO: 10059026 - DNA, 22 bp, Homo sapiens
tctcatgctgtagtgcactaac

SEQ ID NO: 10059027 - DNA, 22 bp, Homo sapiens
tctcacagttgtcccttgtgag

SEQ ID NO: 10059028 - DNA, 22 bp, Homo sapiens
tctcgctctgtcgcccaggctg

SEQ ID NO: 10059029 - DNA, 22 bp, Homo sapiens
tctctcagatggggcactagta

SEQ ID NO: 10059030 - DNA, 18 bp, Homo sapiens
tctctccatctatttgtt

SEQ ID NO: 10059031 - DNA, 22 bp, Homo sapiens
tctctccaacatggtggtgctg

SEQ ID NO: 10059032 - DNA, 16 bp, Homo sapiens
tctctgcttcataggt

SEQ ID NO: 10059033 - DNA, 20 bp, Homo sapiens
tctctgctgtccacatttgc

SEQ ID NO: 10059034 - DNA, 22 bp, Homo sapiens
tctctgctctgtgcctcagttt

SEQ ID NO: 10059035 - DNA, 22 bp, Homo sapiens
tctctgctcaggcaccagccct

SEQ ID NO: 10059036 - DNA, 22 bp, Homo sapiens
tctgaagagaatgctgctgaac

SEQ ID NO: 10059037 - DNA, 22 bp, Homo sapiens
tcttggctactttcctgtctgc

SEQ ID NO: 10059038 - DNA, 22 bp, Homo sapiens
tcttggcttttcccctatggtc

SEQ ID NO: 10059039 - DNA, 22 bp, Homo sapiens
tcttccaggccctgccacagct

SEQ ID NO: 10059040 - DNA, 22 bp, Homo sapiens
tcttcaaagaagccttggatta

SEQ ID NO: 10059041 - DNA, 22 bp, Homo sapiens
tcttcaaatcctacagtgtctg

SEQ ID NO: 10059042 - DNA, 23 bp, Homo sapiens
tctgtctgaataatttactcttt

SEQ ID NO: 10059043 - DNA, 22 bp, Homo sapiens
tctgttttagataagaaaggct

SEQ ID NO: 10059044 - DNA, 22 bp, Homo sapiens
tctgtttcttcctagccatgct

SEQ ID NO: 10059045 - DNA, 22 bp, Homo sapiens
tctgtttcttcttctgttatat

SEQ ID NO: 10059046 - DNA, 22 bp, Homo sapiens
tctgtttctataaagacaagag

SEQ ID NO: 10059047 - DNA, 22 bp, Homo sapiens
tcttaactatcatttgaacacc

SEQ ID NO: 10059048 - DNA, 22 bp, Homo sapiens
tctgtctgcttcacttgcattt

SEQ ID NO: 10059049 - DNA, 22 bp, Homo sapiens
tctgacttccttttctgatcca

SEQ ID NO: 10059050 - DNA, 22 bp, Homo sapiens
tctgcctgctaactcctgcacc

SEQ ID NO: 10059051 - DNA, 22 bp, Homo sapiens
tctgcctggagagttcttctct

SEQ ID NO: 10059052 - DNA, 22 bp, Homo sapiens
tctgcctggaccctggtgagct

SEQ ID NO: 10059053 - DNA, 22 bp, Homo sapiens
tctgcctgcttcttcatagtct

SEQ ID NO: 10059054 - DNA, 22 bp, Homo sapiens
tctgcctgctgcctgggggctc

SEQ ID NO: 10059055 - DNA, 19 bp, Homo sapiens
tctgcctgcttgtaggggc

SEQ ID NO: 10059056 - DNA, 22 bp, Homo sapiens
tctgcctgtaatatttggagaa

SEQ ID NO: 10059057 - DNA, 22 bp, Homo sapiens
tctgcctgtacctcttttttgc

SEQ ID NO: 10059058 - DNA, 22 bp, Homo sapiens
tctgcctggattccattctcca

SEQ ID NO: 10059059 - DNA, 22 bp, Homo sapiens
tctgcctgttgagcctaaggcc

SEQ ID NO: 10059060 - DNA, 22 bp, Homo sapiens
tctgcctgtgctgtgttttcat

SEQ ID NO: 10059061 - DNA, 22 bp, Homo sapiens
tctgcctgttcaagtcttctag

SEQ ID NO: 10059062 - DNA, 22 bp, Homo sapiens
tctgcctgcgctcacggggccg

SEQ ID NO: 10059063 - DNA, 22 bp, Homo sapiens
tctgcctgccagtctggtcctc

SEQ ID NO: 10059064 - DNA, 21 bp, Homo sapiens
tctgcctgagactttgctggt

SEQ ID NO: 10059065 - DNA, 22 bp, Homo sapiens
tctgccaggttgttatgctact

SEQ ID NO: 10059066 - DNA, 22 bp, Homo sapiens
tctggaaggcttcaaggtctaa

SEQ ID NO: 10059067 - DNA, 22 bp, Homo sapiens
tctggaaggaagagctgagtcc

SEQ ID NO: 10059068 - DNA, 22 bp, Homo sapiens
tctggaagtcccttgatgccag

SEQ ID NO: 10059069 - DNA, 22 bp, Homo sapiens
tctggaaggttggctcccagtt

SEQ ID NO: 10059070 - DNA, 22 bp, Homo sapiens
tctggaaggggatctgtggtca

SEQ ID NO: 10059071 - DNA, 22 bp, Homo sapiens
tctggaaggaacccttagagga

SEQ ID NO: 10059072 - DNA, 22 bp, Homo sapiens
tctggaagacagtgagcccgct

SEQ ID NO: 10059073 - DNA, 22 bp, Homo sapiens
tctgctgtgatttgctacctgt

SEQ ID NO: 10059074 - DNA, 22 bp, Homo sapiens
tctgctctccatacttccgcac

SEQ ID NO: 10059075 - DNA, 22 bp, Homo sapiens
tctgctctagttgcttcctgcc

SEQ ID NO: 10059076 - DNA, 22 bp, Homo sapiens
tctggcccagcccctgatccca

SEQ ID NO: 10059077 - DNA, 22 bp, Homo sapiens
tctggcccctggcagtcctgga

SEQ ID NO: 10059078 - DNA, 22 bp, Homo sapiens
tctggccctatggcatgtacct

SEQ ID NO: 10059079 - DNA, 20 bp, Homo sapiens
tctggccccttcctgtcctg

SEQ ID NO: 10059080 - DNA, 22 bp, Homo sapiens
aaagatcattctctggtccaga

SEQ ID NO: 10059081 - DNA, 22 bp, Homo sapiens
aaaccacatgccttcaaatgct

SEQ ID NO: 10059082 - DNA, 22 bp, Homo sapiens
aagaaataagacttctctgtcc

SEQ ID NO: 10059083 - DNA, 22 bp, Homo sapiens
aacttttcattgaatcatgtca

SEQ ID NO: 10059084 - DNA, 22 bp, Homo sapiens
aacttttcattccaaaggtgct

SEQ ID NO: 10059085 - DNA, 17 bp, Homo sapiens
aagacagaagccatgag

SEQ ID NO: 10059086 - DNA, 22 bp, Homo sapiens
aagacagaccacgtgacagggc

SEQ ID NO: 10059087 - DNA, 22 bp, Homo sapiens
aagagcatcggtggagccccca

SEQ ID NO: 10059088 - DNA, 22 bp, Homo sapiens
aagagcatctatttcacagtgg

SEQ ID NO: 10059089 - DNA, 22 bp, Homo sapiens
aaagcacatgagtagtgtagta

SEQ ID NO: 10059090 - DNA, 22 bp, Homo sapiens
aacacataggcagagcatgaca

SEQ ID NO: 10059091 - DNA, 22 bp, Homo sapiens
aacacatatttttgctgagcat

SEQ ID NO: 10059092 - DNA, 22 bp, Homo sapiens
aacacatatttatatatgcaca

SEQ ID NO: 10059093 - DNA, 22 bp, Homo sapiens
aactatcacaaacagagtgtct

SEQ ID NO: 10059094 - DNA, 22 bp, Homo sapiens
aactcaaagatgcatgacgctt

SEQ ID NO: 10059095 - DNA, 22 bp, Homo sapiens
aactcagacatgtataaagact

SEQ ID NO: 10059096 - DNA, 22 bp, Homo sapiens
aacagtagtggtcaatatgcca

SEQ ID NO: 10059097 - DNA, 22 bp, Homo sapiens
aatatttcttctaaagcccttt

SEQ ID NO: 10059098 - DNA, 22 bp, Homo sapiens
aaggccactttaccttaaatcc

SEQ ID NO: 10059099 - DNA, 22 bp, Homo sapiens
aagtatgacatttaagacaatt

SEQ ID NO: 10059100 - DNA, 22 bp, Homo sapiens
acagaagcagccgtcacagata

SEQ ID NO: 10059101 - DNA, 22 bp, Homo sapiens
acagaagaccaagaaagcttcc

SEQ ID NO: 10059102 - DNA, 17 bp, Homo sapiens
acagagcacatcaagat

SEQ ID NO: 10059103 - DNA, 22 bp, Homo sapiens
aagcacattatagctatctagg

SEQ ID NO: 10059104 - DNA, 22 bp, Homo sapiens
aagcacatgaaaatgtgaagct

SEQ ID NO: 10059105 - DNA, 22 bp, Homo sapiens
acagatgaaaaagcttgtggat

SEQ ID NO: 10059106 - DNA, 22 bp, Homo sapiens
acacacatgcatgcttgccatt

SEQ ID NO: 10059107 - DNA, 22 bp, Homo sapiens
aagagtctattggaactagaca

SEQ ID NO: 10059108 - DNA, 22 bp, Homo sapiens
aatgtcttttaaatgttgaggt

SEQ ID NO: 10059109 - DNA, 23 bp, Homo sapiens
aactcctgaatcgtgagccatct

SEQ ID NO: 10059110 - DNA, 22 bp, Homo sapiens
acaagaagggtgattaggggca

SEQ ID NO: 10059111 - DNA, 17 bp, Homo sapiens
aagacaagacaaatgca

SEQ ID NO: 10059112 - DNA, 22 bp, Homo sapiens
aagtgcaaatctgtggctgaaa

SEQ ID NO: 10059113 - DNA, 22 bp, Homo sapiens
aagtgcaatgaatagctgcaat

SEQ ID NO: 10059114 - DNA, 22 bp, Homo sapiens
aagtgcaatttgaaattctgca

SEQ ID NO: 10059115 - DNA, 22 bp, Homo sapiens
aagtctgactagaatctctccc

SEQ ID NO: 10059116 - DNA, 22 bp, Homo sapiens
agaaaccagacttggcccattt

SEQ ID NO: 10059117 - DNA, 22 bp, Homo sapiens
acataagttatggataaaatgt

SEQ ID NO: 10059118 - DNA, 22 bp, Homo sapiens
acataataggtacctgaataat

SEQ ID NO: 10059119 - DNA, 22 bp, Homo sapiens
acataataggtgcctgaatatt

SEQ ID NO: 10059120 - DNA, 22 bp, Homo sapiens
acatacaaatagagctgtagta

SEQ ID NO: 10059121 - DNA, 22 bp, Homo sapiens
acagtgtagtgtgatgtcaaaa

SEQ ID NO: 10059122 - DNA, 22 bp, Homo sapiens
acagaactgggggcacagatag

SEQ ID NO: 10059123 - DNA, 22 bp, Homo sapiens
acagaactgggaaatgcacata

SEQ ID NO: 10059124 - DNA, 22 bp, Homo sapiens
agcccctgtttttccagtcaga

SEQ ID NO: 10059125 - DNA, 23 bp, Homo sapiens
acacagaagaagacccaaggaag

SEQ ID NO: 10059126 - DNA, 22 bp, Homo sapiens
acaaaaagctccattactgtcc

SEQ ID NO: 10059127 - DNA, 22 bp, Homo sapiens
agagcagcgtttgtggaacact

SEQ ID NO: 10059128 - DNA, 22 bp, Homo sapiens
agagagcaggacttcactgagc

SEQ ID NO: 10059129 - DNA, 22 bp, Homo sapiens
cagatgtgcatgatgggaaggg

SEQ ID NO: 10059130 - DNA, 22 bp, Homo sapiens
agctacttccctgtaggaaaca

SEQ ID NO: 10059131 - DNA, 22 bp, Homo sapiens
agcccaggttgaggctgcagtg

SEQ ID NO: 10059132 - DNA, 22 bp, Homo sapiens
agcagtgatgcatgacagccta

SEQ ID NO: 10059133 - DNA, 22 bp, Homo sapiens
cactgtttggctcctgtactta

SEQ ID NO: 10059134 - DNA, 22 bp, Homo sapiens
cacagagattagaattagacta

SEQ ID NO: 10059135 - DNA, 22 bp, Homo sapiens
agcaacatttttcaattaacat

SEQ ID NO: 10059136 - DNA, 22 bp, Homo sapiens
atgaagtctatttacctaagct

SEQ ID NO: 10059137 - DNA, 22 bp, Homo sapiens
atgaaggcagttaaacgtcatc

SEQ ID NO: 10059138 - DNA, 22 bp, Homo sapiens
agacaacaccaaatgctagtgt

SEQ ID NO: 10059139 - DNA, 22 bp, Homo sapiens
agacaacatcactaaagctgag

SEQ ID NO: 10059140 - DNA, 22 bp, Homo sapiens
agacaacatctagtttggtgga

SEQ ID NO: 10059141 - DNA, 22 bp, Homo sapiens
agacaacatgatcagcagtcct

SEQ ID NO: 10059142 - DNA, 22 bp, Homo sapiens
atgccttttcgggtacttctct

SEQ ID NO: 10059143 - DNA, 19 bp, Homo sapiens
agacttttgtaagttgaga

SEQ ID NO: 10059144 - DNA, 23 bp, Homo sapiens
atacaaaccttgcaggacatgtt

SEQ ID NO: 10059145 - DNA, 22 bp, Homo sapiens
actttgcaggtacatgagcatc

SEQ ID NO: 10059146 - DNA, 22 bp, Homo sapiens
ataaagtttaaaagtcaatagt

SEQ ID NO: 10059147 - DNA, 22 bp, Homo sapiens
actgtttctcaaattatgtggt

SEQ ID NO: 10059148 - DNA, 22 bp, Homo sapiens
actgtttctgccacaatagccc

SEQ ID NO: 10059149 - DNA, 22 bp, Homo sapiens
acttaaagtagttttactgtgg

SEQ ID NO: 10059150 - DNA, 22 bp, Homo sapiens
agaaatcatgactaagagcagt

SEQ ID NO: 10059151 - DNA, 22 bp, Homo sapiens
agaaagccttatgtacagaggc

SEQ ID NO: 10059152 - DNA, 22 bp, Homo sapiens
agaaagcctcaatcttcaggcc

SEQ ID NO: 10059153 - DNA, 22 bp, Homo sapiens
agaaagcccaggagaacagatt

SEQ ID NO: 10059154 - DNA, 22 bp, Homo sapiens
agaaagccaatctgtaaagtct

SEQ ID NO: 10059155 - DNA, 22 bp, Homo sapiens
agaaagcccacccagaagatgt

SEQ ID NO: 10059156 - DNA, 23 bp, Homo sapiens
acttttcaattagctatgcttaa

SEQ ID NO: 10059157 - DNA, 22 bp, Homo sapiens
agtgctctcatgctgactatta

SEQ ID NO: 10059158 - DNA, 22 bp, Homo sapiens
agtgctctgatctccttgggtt

SEQ ID NO: 10059159 - DNA, 22 bp, Homo sapiens
agtgctctgggtccactccaga

SEQ ID NO: 10059160 - DNA, 22 bp, Homo sapiens
actctgctaaatgtaagttggt

SEQ ID NO: 10059161 - DNA, 22 bp, Homo sapiens
actgcctgctcctggctccaca

SEQ ID NO: 10059162 - DNA, 22 bp, Homo sapiens
actgcccattaaaggtgctttg

SEQ ID NO: 10059163 - DNA, 22 bp, Homo sapiens
actctctctgatggaactttag

SEQ ID NO: 10059164 - DNA, 22 bp, Homo sapiens
actctaaatagcctcttaaaca

SEQ ID NO: 10059165 - DNA, 23 bp, Homo sapiens
aggtcaaccacaagctgacaaac

SEQ ID NO: 10059166 - DNA, 22 bp, Homo sapiens
aggccacagagagtgcatgtgc

SEQ ID NO: 10059167 - DNA, 18 bp, Homo sapiens
aggccacactccagaaca

SEQ ID NO: 10059168 - DNA, 22 bp, Homo sapiens
aggccacaggcaccctgtgttc

SEQ ID NO: 10059169 - DNA, 22 bp, Homo sapiens
accatacttgaaatggatagga

SEQ ID NO: 10059170 - DNA, 22 bp, Homo sapiens
accaagctagaacattacaggc

SEQ ID NO: 10059171 - DNA, 22 bp, Homo sapiens
accctggaggtggaggtgcagt

SEQ ID NO: 10059172 - DNA, 22 bp, Homo sapiens
acatacacgggaaacctctttt

SEQ ID NO: 10059173 - DNA, 22 bp, Homo sapiens
aggcaacatgactcacttgcac

SEQ ID NO: 10059174 - DNA, 22 bp, Homo sapiens
aggagacatggaatagtgaggc

SEQ ID NO: 10059175 - DNA, 22 bp, Homo sapiens
acagcccagctctttctctgca

SEQ ID NO: 10059176 - DNA, 22 bp, Homo sapiens
aggtacagatgaaagtctagtt

SEQ ID NO: 10059177 - DNA, 21 bp, Homo sapiens
ctattggaaaagaaaatattt

SEQ ID NO: 10059178 - DNA, 19 bp, Homo sapiens
agtgccttgctctctaggt

SEQ ID NO: 10059179 - DNA, 22 bp, Homo sapiens
agtggacattctgcacttggag

SEQ ID NO: 10059180 - DNA, 18 bp, Homo sapiens
atattcaagaagacagag

SEQ ID NO: 10059181 - DNA, 22 bp, Homo sapiens
atatacacatgtgtatacattt

SEQ ID NO: 10059182 - DNA, 19 bp, Homo sapiens
atatacatactgtgtgcat

SEQ ID NO: 10059183 - DNA, 22 bp, Homo sapiens
atacatgtgccatgttggtgta

SEQ ID NO: 10059184 - DNA, 22 bp, Homo sapiens
atacatgtgccgcgttggtgtg

SEQ ID NO: 10059185 - DNA, 22 bp, Homo sapiens
atacatgtgctatgttggtgta

SEQ ID NO: 10059186 - DNA, 20 bp, Homo sapiens
atacacatgcagacagatgc

SEQ ID NO: 10059187 - DNA, 20 bp, Homo sapiens
atacacattcatagaaaaat

SEQ ID NO: 10059188 - DNA, 22 bp, Homo sapiens
atacaagttctcatgtgtatct

SEQ ID NO: 10059189 - DNA, 19 bp, Homo sapiens
atacacatacgtaaactga

SEQ ID NO: 10059190 - DNA, 22 bp, Homo sapiens
atacacatatatacacgtttaa

SEQ ID NO: 10059191 - DNA, 22 bp, Homo sapiens
atacacatctatttaagagaca

SEQ ID NO: 10059192 - DNA, 22 bp, Homo sapiens
atacacatatgtgtgtatatgt

SEQ ID NO: 10059193 - DNA, 20 bp, Homo sapiens
atacacatattcttgcaact

SEQ ID NO: 10059194 - DNA, 22 bp, Homo sapiens
ataaaagaagttttggtacttg

SEQ ID NO: 10059195 - DNA, 22 bp, Homo sapiens
agttctaagatgctccacagag

SEQ ID NO: 10059196 - DNA, 22 bp, Homo sapiens
catcagaagaaagacaaatgat

SEQ ID NO: 10059197 - DNA, 22 bp, Homo sapiens
agctttctagtttagccatctt

SEQ ID NO: 10059198 - DNA, 22 bp, Homo sapiens
aggctacttctagagggacaat

SEQ ID NO: 10059199 - DNA, 22 bp, Homo sapiens
aggccacatagcttgcatgtag

SEQ ID NO: 10059200 - DNA, 22 bp, Homo sapiens
aggccacaagaactaccccatc

SEQ ID NO: 10059201 - DNA, 22 bp, Homo sapiens
ccagaaagataggaaatcaagt

SEQ ID NO: 10059202 - DNA, 21 bp, Homo sapiens
ggagtttttctggaagggact

SEQ ID NO: 10059203 - DNA, 22 bp, Homo sapiens
caccacagcatccactagaagg

SEQ ID NO: 10059204 - DNA, 22 bp, Homo sapiens
cacccaggcaaggattctgcaa

SEQ ID NO: 10059205 - DNA, 22 bp, Homo sapiens
ggacaacacttcattccagcta

SEQ ID NO: 10059206 - DNA, 22 bp, Homo sapiens
ggacaacatgttttaattaagg

SEQ ID NO: 10059207 - DNA, 21 bp, Homo sapiens
caatggcgagatcttggctca

SEQ ID NO: 10059208 - DNA, 22 bp, Homo sapiens
gtgcatgtcggggtgcatgtca

SEQ ID NO: 10059209 - DNA, 22 bp, Homo sapiens
gtgcaaagcttaacattctgca

SEQ ID NO: 10059210 - DNA, 22 bp, Homo sapiens
cagcagaagtgcatttgtgatt

SEQ ID NO: 10059211 - DNA, 22 bp, Homo sapiens
cagataaaggcttactagtagt

SEQ ID NO: 10059212 - DNA, 20 bp, Homo sapiens
gctctaaagccacagattga

SEQ ID NO: 10059213 - DNA, 22 bp, Homo sapiens
gcccagccacagtcactttcat

SEQ ID NO: 10059214 - DNA, 22 bp, Homo sapiens
attgttcagagtagggctctgt

SEQ ID NO: 10059215 - DNA, 22 bp, Homo sapiens
attgttcactgtgaatcttgat

SEQ ID NO: 10059216 - DNA, 22 bp, Homo sapiens
gccactgtcatcttgtgaagca

SEQ ID NO: 10059217 - DNA, 22 bp, Homo sapiens
gcaacacagatcttctttgttg

SEQ ID NO: 10059218 - DNA, 22 bp, Homo sapiens
gcaaaaattccagggacgactc

SEQ ID NO: 10059219 - DNA, 22 bp, Homo sapiens
atgcccaggcccatacctagat

SEQ ID NO: 10059220 - DNA, 22 bp, Homo sapiens
gagttacacagaagtcagtttg

SEQ ID NO: 10059221 - DNA, 22 bp, Homo sapiens
atgtttcctgttggattggccc

SEQ ID NO: 10059222 - DNA, 22 bp, Homo sapiens
atgtttcccttctgatttggga

SEQ ID NO: 10059223 - DNA, 22 bp, Homo sapiens
atgtttcccagagcaaatctgg

SEQ ID NO: 10059224 - DNA, 22 bp, Homo sapiens
atgtttccatgttcaatttact

SEQ ID NO: 10059225 - DNA, 22 bp, Homo sapiens
atgtttccattttcttgtatca

SEQ ID NO: 10059226 - DNA, 22 bp, Homo sapiens
atgtttccatagaagtcacagt

SEQ ID NO: 10059227 - DNA, 22 bp, Homo sapiens
atgtttccagctcagctgcagg

SEQ ID NO: 10059228 - DNA, 22 bp, Homo sapiens
atgtttccagatatgtcaccct

SEQ ID NO: 10059229 - DNA, 22 bp, Homo sapiens
atgtttcatccactggcctttc

SEQ ID NO: 10059230 - DNA, 22 bp, Homo sapiens
atgtttcaggcgaactaacatg

SEQ ID NO: 10059231 - DNA, 22 bp, Homo sapiens
tcttctgatgccagtaaccatg

SEQ ID NO: 10059232 - DNA, 22 bp, Homo sapiens
tcttctgaaggtaggaagcatt

SEQ ID NO: 10059233 - DNA, 19 bp, Homo sapiens
tcttctgacttcaagaaac

SEQ ID NO: 10059234 - DNA, 22 bp, Homo sapiens
tgggacagggaatctgatcccc

SEQ ID NO: 10059235 - DNA, 22 bp, Homo sapiens
cctctccagttttaacgtgacc

SEQ ID NO: 10059236 - DNA, 22 bp, Homo sapiens
ccctggaggttgaggctgcagt

SEQ ID NO: 10059237 - DNA, 22 bp, Homo sapiens
ccctggaggtggaggttgcagg

SEQ ID NO: 10059238 - DNA, 22 bp, Homo sapiens
tcctgagggctcggggctcatg

SEQ ID NO: 10059239 - DNA, 22 bp, Homo sapiens
tcctgagggcgattcagcaggt

SEQ ID NO: 10059240 - DNA, 22 bp, Homo sapiens
tcctgagggcattttggtgact

SEQ ID NO: 10059241 - DNA, 23 bp, Homo sapiens
tccatactctaaacatgttattt

SEQ ID NO: 10059242 - DNA, 22 bp, Homo sapiens
tcctgaggtggattgagcagag

SEQ ID NO: 10059243 - DNA, 22 bp, Homo sapiens
tcctgaggtgctcagccaggaa

SEQ ID NO: 10059244 - DNA, 22 bp, Homo sapiens
tcctgagggctgcagtcatagg

SEQ ID NO: 10059245 - DNA, 22 bp, Homo sapiens
tctaatgaaagatgtaggaact

SEQ ID NO: 10059246 - DNA, 23 bp, Homo sapiens
tctatacatactgcagcctctgg

SEQ ID NO: 10059247 - DNA, 21 bp, Homo sapiens
tccagggtcagaagttcagtg

SEQ ID NO: 10059248 - DNA, 22 bp, Homo sapiens
tccagggttgtgggcttcagca

SEQ ID NO: 10059249 - DNA, 22 bp, Homo sapiens
catgttttgtgtacagaatatt

SEQ ID NO: 10059250 - DNA, 22 bp, Homo sapiens
tcataatgtagttcatggctgg

SEQ ID NO: 10059251 - DNA, 22 bp, Homo sapiens
tcatacaagatcactttggcca

SEQ ID NO: 10059252 - DNA, 20 bp, Homo sapiens
tcatacacatgagcatgcag

SEQ ID NO: 10059253 - DNA, 22 bp, Homo sapiens
tacctctcggggtctgtttgtg

SEQ ID NO: 10059254 - DNA, 22 bp, Homo sapiens
tagaaagcagtatctccatttt

SEQ ID NO: 10059255 - DNA, 22 bp, Homo sapiens
tacacagatttcagtatcatca

SEQ ID NO: 10059256 - DNA, 22 bp, Homo sapiens
tacacagaagccagaaggcctg

SEQ ID NO: 10059257 - DNA, 22 bp, Homo sapiens
tacacagatatgtgatcaatca

SEQ ID NO: 10059258 - DNA, 22 bp, Homo sapiens
tacacttataactctgtgtgtg

SEQ ID NO: 10059259 - DNA, 22 bp, Homo sapiens
tacagcattgtgtcttcactca

SEQ ID NO: 10059260 - DNA, 22 bp, Homo sapiens
caggcctgtgacaccgtgtctg

SEQ ID NO: 10059261 - DNA, 22 bp, Homo sapiens
tatgatatgcactttatcagaa

SEQ ID NO: 10059262 - DNA, 22 bp, Homo sapiens
tatgcaaatcattagatttcct

SEQ ID NO: 10059263 - DNA, 22 bp, Homo sapiens
tatatacaaggtaggtttaggt

SEQ ID NO: 10059264 - DNA, 22 bp, Homo sapiens
gagaaagctaaataagttgatt

SEQ ID NO: 10059265 - DNA, 23 bp, Homo sapiens
gagaaagccggctatgatcctgg

SEQ ID NO: 10059266 - DNA, 22 bp, Homo sapiens
gaatgagtagagtataaacaaa

SEQ ID NO: 10059267 - DNA, 22 bp, Homo sapiens
gaatatttgtaattactgttga

SEQ ID NO: 10059268 - DNA, 22 bp, Homo sapiens
ctttgcaatagaggcacacatg

SEQ ID NO: 10059269 - DNA, 22 bp, Homo sapiens
gaaacacatgcagctccataga

SEQ ID NO: 10059270 - DNA, 22 bp, Homo sapiens
gaaagccagagagaaagggctc

SEQ ID NO: 10059271 - DNA, 18 bp, Homo sapiens
gaaagccatgcagcagtg

SEQ ID NO: 10059272 - DNA, 22 bp, Homo sapiens
ctttaacagttccattcaattt

SEQ ID NO: 10059273 - DNA, 22 bp, Homo sapiens
cttctgaatggctgtgtatgct

SEQ ID NO: 10059274 - DNA, 22 bp, Homo sapiens
cttccaaaatttatatgttgaa

SEQ ID NO: 10059275 - DNA, 20 bp, Homo sapiens
cttccacacaagaagcacag

SEQ ID NO: 10059276 - DNA, 22 bp, Homo sapiens
cttctaattcttatgtaagctt

SEQ ID NO: 10059277 - DNA, 22 bp, Homo sapiens
ctgttttctagggctgaggtga

SEQ ID NO: 10059278 - DNA, 22 bp, Homo sapiens
ctgtacatcttaaatggaaaaa

SEQ ID NO: 10059279 - DNA, 22 bp, Homo sapiens
ttgtttactaagaacctggtca

SEQ ID NO: 10059280 - DNA, 22 bp, Homo sapiens
ctcccaggggaactatcaagta

SEQ ID NO: 10059281 - DNA, 22 bp, Homo sapiens
ctccttctcctcgggaggccag

SEQ ID NO: 10059282 - DNA, 22 bp, Homo sapiens
ctctgacagccttcattatgca

SEQ ID NO: 10059283 - DNA, 22 bp, Homo sapiens
ctctcaaatgtcattcctctat

SEQ ID NO: 10059284 - DNA, 20 bp, Homo sapiens
ctctcacagctccctcagcc

SEQ ID NO: 10059285 - DNA, 22 bp, Homo sapiens
ctctgctggcagcccccgggcc

SEQ ID NO: 10059286 - DNA, 22 bp, Homo sapiens
ctctgctgcccatgatggtata

SEQ ID NO: 10059287 - DNA, 22 bp, Homo sapiens
ctctgctggtgaccactgggcc

SEQ ID NO: 10059288 - DNA, 21 bp, Homo sapiens
ctctgctgtctaccagctgtt

SEQ ID NO: 10059289 - DNA, 22 bp, Homo sapiens
ctctgctgtgccgccagggcct

SEQ ID NO: 10059290 - DNA, 19 bp, Homo sapiens
ctctgcttggtccatatgc

SEQ ID NO: 10059291 - DNA, 22 bp, Homo sapiens
ctctgcttgtatcacatttgct

SEQ ID NO: 10059292 - DNA, 22 bp, Homo sapiens
ctctgctgttttgtatacaggc

SEQ ID NO: 10059293 - DNA, 22 bp, Homo sapiens
ctacataaatatttatgtgtct

SEQ ID NO: 10059294 - DNA, 22 bp, Homo sapiens
ctacatactgtgtgtaaagaat

SEQ ID NO: 10059295 - DNA, 22 bp, Homo sapiens
ttctacattcatgtattacctc

SEQ ID NO: 10059296 - DNA, 22 bp, Homo sapiens
ttctacatatatttttctcact

SEQ ID NO: 10059297 - DNA, 22 bp, Homo sapiens
ctagtgtgtctatgtctgttcc

SEQ ID NO: 10059298 - DNA, 22 bp, Homo sapiens
ctcagaaagcaatctggtgagg

SEQ ID NO: 10059299 - DNA, 22 bp, Homo sapiens
ttcttaagtttagcaacttgtg

SEQ ID NO: 10059300 - DNA, 22 bp, Homo sapiens
ttcttcagggaagcttgttaat

SEQ ID NO: 10059301 - DNA, 22 bp, Homo sapiens
ttcttcagtcccactagccaca

SEQ ID NO: 10059302 - DNA, 22 bp, Homo sapiens
ttcttcagtgtagcaactgtat

SEQ ID NO: 10059303 - DNA, 22 bp, Homo sapiens
tgtttcttctcacacaaactca

SEQ ID NO: 10059304 - DNA, 22 bp, Homo sapiens
tgttttctcttgaaaagcagtc

SEQ ID NO: 10059305 - DNA, 22 bp, Homo sapiens
ttatgtatgaatatagtagaag

SEQ ID NO: 10059306 - DNA, 18 bp, Homo sapiens
ccttctgacgcttgagaa

SEQ ID NO: 10059307 - DNA, 22 bp, Homo sapiens
ccttctgagcttcaatttcagt

SEQ ID NO: 10059308 - DNA, 22 bp, Homo sapiens
ccttctgagtgtggacccctgt

SEQ ID NO: 10059309 - DNA, 22 bp, Homo sapiens
ccttctgataactgtgaaattg

SEQ ID NO: 10059310 - DNA, 22 bp, Homo sapiens
ccttctgatactgacatcattt

SEQ ID NO: 10059311 - DNA, 20 bp, Homo sapiens
ttacagaaatgatgttattt

SEQ ID NO: 10059312 - DNA, 22 bp, Homo sapiens
ttatggctaaatttcaatatta

SEQ ID NO: 10059313 - DNA, 22 bp, Homo sapiens
tattcacatgaaaacaaatttt

SEQ ID NO: 10059314 - DNA, 22 bp, Homo sapiens
tattcaaagtgcgaggtcaggg

SEQ ID NO: 10059315 - DNA, 17 bp, Homo sapiens
tatgtgtgtttgcagca

SEQ ID NO: 10059316 - DNA, 22 bp, Homo sapiens
tatttccaggccccactctaga

SEQ ID NO: 10059317 - DNA, 22 bp, Homo sapiens
tattttcattctgtgtgactgt

SEQ ID NO: 10059318 - DNA, 22 bp, Homo sapiens
tatattcaacaggctaatgtca

SEQ ID NO: 10059319 - DNA, 22 bp, Homo sapiens
tatatgtagtcagtcagagtaa

SEQ ID NO: 10059320 - DNA, 22 bp, Homo sapiens
taggaagcatttaaagagatgg

SEQ ID NO: 10059321 - DNA, 22 bp, Homo sapiens
tactttcatgtctatacatatt

SEQ ID NO: 10059322 - DNA, 22 bp, Homo sapiens
tactgccaaattgcagcaatgt

SEQ ID NO: 10059323 - DNA, 22 bp, Homo sapiens
tacatacatggtggaatggtta

SEQ ID NO: 10059324 - DNA, 22 bp, Homo sapiens
tacatacatattcatacaggtg

SEQ ID NO: 10059325 - DNA, 22 bp, Homo sapiens
tacatacacaaatatactgttt

SEQ ID NO: 10059326 - DNA, 22 bp, Homo sapiens
tacatacacaaatgctgaatgg

SEQ ID NO: 10059327 - DNA, 22 bp, Homo sapiens
tacatacagccaagtatgaagt

SEQ ID NO: 10059328 - DNA, 22 bp, Homo sapiens
taatgctaacatcatatcactg

SEQ ID NO: 10059329 - DNA, 22 bp, Homo sapiens
tacacatatgtccattaatcag

SEQ ID NO: 10059330 - DNA, 22 bp, Homo sapiens
tacacatatgtgtgtatatgtg

SEQ ID NO: 10059331 - DNA, 22 bp, Homo sapiens
tacacattacataatactatct

SEQ ID NO: 10059332 - DNA, 22 bp, Homo sapiens
taaactgtggaatgttctcttt

SEQ ID NO: 10059333 - DNA, 22 bp, Homo sapiens
taaagtgtggacagtatctata

SEQ ID NO: 10059334 - DNA, 22 bp, Homo sapiens
taaagtgtgtatatacatatgg

SEQ ID NO: 10059335 - DNA, 22 bp, Homo sapiens
taaagtgtgtgggttctaaatt

SEQ ID NO: 10059336 - DNA, 22 bp, Homo sapiens
taaagtgttgtacaaatgtatg

SEQ ID NO: 10059337 - DNA, 22 bp, Homo sapiens
tcatgtttttgccatatgactc

SEQ ID NO: 10059338 - DNA, 22 bp, Homo sapiens
tccaggacctgactgggcctgc

SEQ ID NO: 10059339 - DNA, 22 bp, Homo sapiens
tcctcctgctgttagtcttgaa

SEQ ID NO: 10059340 - DNA, 20 bp, Homo sapiens
tcctccaaccagctgctaat

SEQ ID NO: 10059341 - DNA, 22 bp, Homo sapiens
tccgggaggcagaggttgcagt

SEQ ID NO: 10059342 - DNA, 22 bp, Homo sapiens
tcaggtgacctgagccactatg

SEQ ID NO: 10059343 - DNA, 20 bp, Homo sapiens
tcaggtgacacacgtggcac

SEQ ID NO: 10059344 - DNA, 22 bp, Homo sapiens
tcataaagatactaagtgagtt

SEQ ID NO: 10059345 - DNA, 22 bp, Homo sapiens
tcataaagagtgctgttgtttt

SEQ ID NO: 10059346 - DNA, 22 bp, Homo sapiens
tcaaacagaggaacaattgttt

SEQ ID NO: 10059347 - DNA, 22 bp, Homo sapiens
tcacagaatgtctagcataatt

SEQ ID NO: 10059348 - DNA, 22 bp, Homo sapiens
tcacagagagtgacttgttgct

SEQ ID NO: 10059349 - DNA, 22 bp, Homo sapiens
tcacagagatgaacttttgata

SEQ ID NO: 10059350 - DNA, 22 bp, Homo sapiens
gctgccatgccacagcactcac

SEQ ID NO: 10059351 - DNA, 22 bp, Homo sapiens
gctgccatggcctcctgcaagg

SEQ ID NO: 10059352 - DNA, 22 bp, Homo sapiens
ggatgttgattgaatggccatt

SEQ ID NO: 10059353 - DNA, 22 bp, Homo sapiens
ggatgacaaggaaagcaaacca

SEQ ID NO: 10059354 - DNA, 22 bp, Homo sapiens
gggcagtgacaaaggggatgaa

SEQ ID NO: 10059355 - DNA, 22 bp, Homo sapiens
ggtcttctggaaagcagactgt

SEQ ID NO: 10059356 - DNA, 22 bp, Homo sapiens
gtagacagcaaccaaaccaggt

SEQ ID NO: 10059357 - DNA, 22 bp, Homo sapiens
tttccttcttagcggtgttctt

SEQ ID NO: 10059358 - DNA, 22 bp, Homo sapiens
tttacagatgtggaaagtgagc

SEQ ID NO: 10059359 - DNA, 22 bp, Homo sapiens
tttacagatgaggatactgagg

SEQ ID NO: 10059360 - DNA, 22 bp, Homo sapiens
ttgctacatggtttcaaagctg

SEQ ID NO: 10059361 - DNA, 22 bp, Homo sapiens
ttggaatagggaggctggcata

SEQ ID NO: 10059362 - DNA, 22 bp, Homo sapiens
ttggcaaaggactcaaagcagg

SEQ ID NO: 10059363 - DNA, 22 bp, Homo sapiens
ttggggaagctttgaaatactt

SEQ ID NO: 10059364 - DNA, 22 bp, Homo sapiens
ttgttcatcgtccttgctctgt

SEQ ID NO: 10059365 - DNA, 22 bp, Homo sapiens
ttgttcattagcgcttgggcac

SEQ ID NO: 10059366 - DNA, 22 bp, Homo sapiens
ttgttctagcctcctgttttga

SEQ ID NO: 10059367 - DNA, 22 bp, Homo sapiens
ttgttcctgccaagccaagcct

SEQ ID NO: 10059368 - DNA, 22 bp, Homo sapiens
ttcagacacagcgctgggaaat

SEQ ID NO: 10059369 - DNA, 22 bp, Homo sapiens
ttcagaaatgaatattggtatt

SEQ ID NO: 10059370 - DNA, 22 bp, Homo sapiens
ttcagaaatgtcagccatcaga

SEQ ID NO: 10059371 - DNA, 22 bp, Homo sapiens
ttcaagtaatgctactcctatg

SEQ ID NO: 10059372 - DNA, 22 bp, Homo sapiens
ttccaatgacatttgttttaaa

SEQ ID NO: 10059373 - DNA, 22 bp, Homo sapiens
ttatggaaaactccagagagta

SEQ ID NO: 10059374 - DNA, 22 bp, Homo sapiens
ttatggaatggagaaagtctgc

SEQ ID NO: 10059375 - DNA, 22 bp, Homo sapiens
ttcaagatccagcacaacagtg

SEQ ID NO: 10059376 - DNA, 22 bp, Homo sapiens
ttcaaacaactcatttatgcaa

SEQ ID NO: 10059377 - DNA, 22 bp, Homo sapiens
ttcaagatgacccagtcacacg

SEQ ID NO: 10059378 - DNA, 22 bp, Homo sapiens
ttcaagatgtcttcacaatagt

SEQ ID NO: 10059379 - DNA, 22 bp, Homo sapiens
ttctaaagcctgtcctatcaga

SEQ ID NO: 10059380 - DNA, 22 bp, Homo sapiens
ttctaaatggggatcctttctg

SEQ ID NO: 10059381 - DNA, 22 bp, Homo sapiens
ttctaaagtgcaatctgacaga

SEQ ID NO: 10059382 - DNA, 22 bp, Homo sapiens
ttctaactcaaagcttctttca

SEQ ID NO: 10059383 - DNA, 22 bp, Homo sapiens
ttctaactttcaaggtcctttc

SEQ ID NO: 10059384 - DNA, 22 bp, Homo sapiens
ttctaacttaacactcctgtga

SEQ ID NO: 10059385 - DNA, 22 bp, Homo sapiens
ttcttcctctgtaaaaggtgac

SEQ ID NO: 10059386 - DNA, 22 bp, Homo sapiens
ttcttcagcccatatcttccag

SEQ ID NO: 10059387 - DNA, 22 bp, Homo sapiens
ttgagactcgagtctctcagac

SEQ ID NO: 10059388 - DNA, 22 bp, Homo sapiens
ttgagactgagtctcgccctgt

SEQ ID NO: 10059389 - DNA, 22 bp, Homo sapiens
ttgagacagtggggtgttgccg

SEQ ID NO: 10059390 - DNA, 22 bp, Homo sapiens
tttgaacaggagtatctatagt

SEQ ID NO: 10059391 - DNA, 23 bp, Homo sapiens
tttgaacatttctagattacata

SEQ ID NO: 10059392 - DNA, 22 bp, Homo sapiens
tttgaacatgctgcatgataat

SEQ ID NO: 10059393 - DNA, 18 bp, Homo sapiens
atatgcttgagctaagga

SEQ ID NO: 10059394 - DNA, 22 bp, Homo sapiens
agaacagcagtagtatacagta

SEQ ID NO: 10059395 - DNA, 22 bp, Homo sapiens
agaacagcttgcctttaataga

SEQ ID NO: 10059396 - DNA, 22 bp, Homo sapiens
atctattttaaatggcagtaaa

SEQ ID NO: 10059397 - DNA, 22 bp, Homo sapiens
ataatccatgtctagagtaaag

SEQ ID NO: 10059398 - DNA, 22 bp, Homo sapiens
actgtacatgtaaacattgtca

SEQ ID NO: 10059399 - DNA, 22 bp, Homo sapiens
actgtatagtatttattcttag

SEQ ID NO: 10059400 - DNA, 22 bp, Homo sapiens
acttctgataaagagcatgtgc

SEQ ID NO: 10059401 - DNA, 22 bp, Homo sapiens
acttctgattacacatgggcct

SEQ ID NO: 10059402 - DNA, 22 bp, Homo sapiens
acttctgattaaggatgaatgc

SEQ ID NO: 10059403 - DNA, 19 bp, Homo sapiens
acttctgaggaactgcaca

SEQ ID NO: 10059404 - DNA, 22 bp, Homo sapiens
acttctgagaaatttaaggaca

SEQ ID NO: 10059405 - DNA, 22 bp, Homo sapiens
acttctgaagcagagatttggg

SEQ ID NO: 10059406 - DNA, 22 bp, Homo sapiens
agtcaacacattaaacctaggg

SEQ ID NO: 10059407 - DNA, 22 bp, Homo sapiens
aggtctaactgatagaattcat

SEQ ID NO: 10059408 - DNA, 19 bp, Homo sapiens
aggtctaatcataagacaa

SEQ ID NO: 10059409 - DNA, 22 bp, Homo sapiens
acatagaagtgatgcttatcca

SEQ ID NO: 10059410 - DNA, 22 bp, Homo sapiens
acatagagtatcatactggatg

SEQ ID NO: 10059411 - DNA, 22 bp, Homo sapiens
acatagaacttcgatgtctttt

SEQ ID NO: 10059412 - DNA, 22 bp, Homo sapiens
acatatttccatgcagcatgtc

SEQ ID NO: 10059413 - DNA, 22 bp, Homo sapiens
acagtggggtcttaatagaaca

SEQ ID NO: 10059414 - DNA, 22 bp, Homo sapiens
acagtcaatgagtgagtgaatg

SEQ ID NO: 10059415 - DNA, 22 bp, Homo sapiens
cagacatcacactcagattgca

SEQ ID NO: 10059416 - DNA, 22 bp, Homo sapiens
agcccaggctggagtgcagtgg

SEQ ID NO: 10059417 - DNA, 22 bp, Homo sapiens
agccatcacttgagaatctatt

SEQ ID NO: 10059418 - DNA, 22 bp, Homo sapiens
agcctctggccctagactgctt

SEQ ID NO: 10059419 - DNA, 22 bp, Homo sapiens
agcctctgtagaaagcagtgtg

SEQ ID NO: 10059420 - DNA, 22 bp, Homo sapiens
agcctctgtgactcacaggtca

SEQ ID NO: 10059421 - DNA, 20 bp, Homo sapiens
cacaagagaatacacactgg

SEQ ID NO: 10059422 - DNA, 22 bp, Homo sapiens
caacagacctggattcaaaaac

SEQ ID NO: 10059423 - DNA, 22 bp, Homo sapiens
agcaaagcagtggctaagctga

SEQ ID NO: 10059424 - DNA, 22 bp, Homo sapiens
agcaaagcatcactccaatctg

SEQ ID NO: 10059425 - DNA, 22 bp, Homo sapiens
agcaaagcactttgcatacata

SEQ ID NO: 10059426 - DNA, 22 bp, Homo sapiens
caaaagtaatgtatgctcatcg

SEQ ID NO: 10059427 - DNA, 22 bp, Homo sapiens
agagcatccatttttgtcacat

SEQ ID NO: 10059428 - DNA, 22 bp, Homo sapiens
atggctagcaccgcgttgctgg

SEQ ID NO: 10059429 - DNA, 22 bp, Homo sapiens
agacaaaggattaatgatgatg

SEQ ID NO: 10059430 - DNA, 22 bp, Homo sapiens
atgaaagcacgtgggaagataa

SEQ ID NO: 10059431 - DNA, 22 bp, Homo sapiens
agacagcatgatacatgatgct

SEQ ID NO: 10059432 - DNA, 22 bp, Homo sapiens
agacatttcctagacatcaatg

SEQ ID NO: 10059433 - DNA, 20 bp, Homo sapiens
acacagtagcaattagtgca

SEQ ID NO: 10059434 - DNA, 22 bp, Homo sapiens
acaaagagggaccagtgacttg

SEQ ID NO: 10059435 - DNA, 22 bp, Homo sapiens
aagagctggattgtgctgcaga

SEQ ID NO: 10059436 - DNA, 22 bp, Homo sapiens
aagagcagtgttttactcagct

SEQ ID NO: 10059437 - DNA, 22 bp, Homo sapiens
aagaaagcattagacaggcatt

SEQ ID NO: 10059438 - DNA, 22 bp, Homo sapiens
aagctgaggatacatgaagcct

SEQ ID NO: 10059439 - DNA, 22 bp, Homo sapiens
aacacatagacgtttgatatca

SEQ ID NO: 10059440 - DNA, 22 bp, Homo sapiens
aaccaccattctctcctcttcc

SEQ ID NO: 10059441 - DNA, 22 bp, Homo sapiens
aaagacattgaagaaggactta

SEQ ID NO: 10059442 - DNA, 22 bp, Homo sapiens
aaaagtattggccaccatttct

SEQ ID NO: 10059443 - DNA, 22 bp, Homo sapiens
aaacagaaatttcctcatgctc

SEQ ID NO: 10059444 - DNA, 22 bp, Homo sapiens
aaaagacatatgtgggcattct

SEQ ID NO: 10059445 - DNA, 21 bp, Homo sapiens
aaagaggttaatattgtaagt

SEQ ID NO: 10059446 - DNA, 22 bp, Homo sapiens
aaagtactgatgccatcagcac

SEQ ID NO: 10059447 - DNA, 22 bp, Homo sapiens
aactaaaggctgttgcagggaa

SEQ ID NO: 10059448 - DNA, 22 bp, Homo sapiens
aaagatatgtctccaaagagat

SEQ ID NO: 10059449 - DNA, 22 bp, Homo sapiens
aaagatcacgtcccaggactcg

SEQ ID NO: 10059450 - DNA, 22 bp, Homo sapiens
aaagctgctgccaatcaggctt

SEQ ID NO: 10059451 - DNA, 19 bp, Homo sapiens
aacagcaacttcctagtca

SEQ ID NO: 10059452 - DNA, 22 bp, Homo sapiens
aacagcaatagcactattcatt

SEQ ID NO: 10059453 - DNA, 22 bp, Homo sapiens
aaatcggttggttcaaggtaat

SEQ ID NO: 10059454 - DNA, 22 bp, Homo sapiens
agctccttgaaggcagtagctg

SEQ ID NO: 10059455 - DNA, 22 bp, Homo sapiens
acagataatacattgtgctaca

SEQ ID NO: 10059456 - DNA, 19 bp, Homo sapiens
agacagagctcagtgggtt

SEQ ID NO: 10059457 - DNA, 22 bp, Homo sapiens
aagttactggcaagggctgcag

SEQ ID NO: 10059458 - DNA, 22 bp, Homo sapiens
actccaggttttttcactgaag

SEQ ID NO: 10059459 - DNA, 22 bp, Homo sapiens
aatatatagaagtacccgttgt

SEQ ID NO: 10059460 - DNA, 22 bp, Homo sapiens
acttgttcattgagtacatatg

SEQ ID NO: 10059461 - DNA, 22 bp, Homo sapiens
accatgccagtggcagccagac

SEQ ID NO: 10059462 - DNA, 22 bp, Homo sapiens
aagggactttgtcagctttcca

SEQ ID NO: 10059463 - DNA, 22 bp, Homo sapiens
acagtaggaatagatgtagata

SEQ ID NO: 10059464 - DNA, 22 bp, Homo sapiens
acagttggttaacacaaatatt

SEQ ID NO: 10059465 - DNA, 22 bp, Homo sapiens
atggcaagcaagctgaagagat

SEQ ID NO: 10059466 - DNA, 21 bp, Homo sapiens
gagacagcccagtgccagggc

SEQ ID NO: 10059467 - DNA, 22 bp, Homo sapiens
atggctctctccttactgctgc

SEQ ID NO: 10059468 - DNA, 22 bp, Homo sapiens
atggctctgctgggcaaagcaa

SEQ ID NO: 10059469 - DNA, 22 bp, Homo sapiens
gagctgccagacatgggaatga

SEQ ID NO: 10059470 - DNA, 21 bp, Homo sapiens
atgggcagaggcagagaggct

SEQ ID NO: 10059471 - DNA, 22 bp, Homo sapiens
atgttacctgttaggtacctgt

SEQ ID NO: 10059472 - DNA, 22 bp, Homo sapiens
atgcagtggcttcagtgtcagt

SEQ ID NO: 10059473 - DNA, 22 bp, Homo sapiens
attgcaaaggtcccattcaaga

SEQ ID NO: 10059474 - DNA, 22 bp, Homo sapiens
gatgtcttctcaactgtagacc

SEQ ID NO: 10059475 - DNA, 20 bp, Homo sapiens
gatgtcttggtcacagtggc

SEQ ID NO: 10059476 - DNA, 22 bp, Homo sapiens
atttcaaggctacagaaacctt

SEQ ID NO: 10059477 - DNA, 22 bp, Homo sapiens
gccatgcctgtgtctccaggcc

SEQ ID NO: 10059478 - DNA, 22 bp, Homo sapiens
attttcagttgaaaaagttggt

SEQ ID NO: 10059479 - DNA, 22 bp, Homo sapiens
attttcagcccccactcgtggc

SEQ ID NO: 10059480 - DNA, 19 bp, Homo sapiens
caagacaaagcccatcttc

SEQ ID NO: 10059481 - DNA, 22 bp, Homo sapiens
caagaagtgtcagctttttaaa

SEQ ID NO: 10059482 - DNA, 22 bp, Homo sapiens
caagaagtcatttagcctctca

SEQ ID NO: 10059483 - DNA, 22 bp, Homo sapiens
caacacaggggttatgccatgg

SEQ ID NO: 10059484 - DNA, 22 bp, Homo sapiens
cacttgttggtggtgaaatcac

SEQ ID NO: 10059485 - DNA, 22 bp, Homo sapiens
cacatgaattcacatgtatttt

SEQ ID NO: 10059486 - DNA, 20 bp, Homo sapiens
gtacacatatatgtatgtgt

SEQ ID NO: 10059487 - DNA, 22 bp, Homo sapiens
gtacacattgtctgtttacttc

SEQ ID NO: 10059488 - DNA, 22 bp, Homo sapiens
gtacacataggttactgattaa

SEQ ID NO: 10059489 - DNA, 22 bp, Homo sapiens
gtacacactgtttgatcatttc

SEQ ID NO: 10059490 - DNA, 22 bp, Homo sapiens
catggaggccaggaaacagcct

SEQ ID NO: 10059491 - DNA, 22 bp, Homo sapiens
ccaaggtggctacagccctgca

SEQ ID NO: 10059492 - DNA, 22 bp, Homo sapiens
cagtgctcatagctgttcctcc

SEQ ID NO: 10059493 - DNA, 22 bp, Homo sapiens
aggactaatttcaggggatata

SEQ ID NO: 10059494 - DNA, 22 bp, Homo sapiens
cagtgctcctgatgtacccttg

SEQ ID NO: 10059495 - DNA, 22 bp, Homo sapiens
catagacattcagcactcacta

SEQ ID NO: 10059496 - DNA, 22 bp, Homo sapiens
caggtgaggctgaacagatgaa

SEQ ID NO: 10059497 - DNA, 22 bp, Homo sapiens
agctgccactgagggtgcacag

SEQ ID NO: 10059498 - DNA, 21 bp, Homo sapiens
agctgccaccctagcttctga

SEQ ID NO: 10059499 - DNA, 22 bp, Homo sapiens
agctgccacatgcccaagggca

SEQ ID NO: 10059500 - DNA, 22 bp, Homo sapiens
ccctggaaggagatgggacatg

SEQ ID NO: 10059501 - DNA, 22 bp, Homo sapiens
ccctggaggcaaaggttgcagt

SEQ ID NO: 10059502 - DNA, 22 bp, Homo sapiens
cctgaggattgttggtgcttcc

SEQ ID NO: 10059503 - DNA, 22 bp, Homo sapiens
cctgaggacagtgtgaccatgg

SEQ ID NO: 10059504 - DNA, 22 bp, Homo sapiens
cctgaggacacacgctgcagga

SEQ ID NO: 10059505 - DNA, 22 bp, Homo sapiens
ctacagaagtttcccttgctta

SEQ ID NO: 10059506 - DNA, 21 bp, Homo sapiens
ctacagaatcgagcattctgg

SEQ ID NO: 10059507 - DNA, 22 bp, Homo sapiens
ctccagttggccccagttggtt

SEQ ID NO: 10059508 - DNA, 22 bp, Homo sapiens
atattttcactgaaccaaagta

SEQ ID NO: 10059509 - DNA, 22 bp, Homo sapiens
atagtatgagctcatacacttg

SEQ ID NO: 10059510 - DNA, 23 bp, Homo sapiens
atatcacacccagtacagtctcc

SEQ ID NO: 10059511 - DNA, 22 bp, Homo sapiens
atccttcaattagaaccaattg

SEQ ID NO: 10059512 - DNA, 22 bp, Homo sapiens
atccttcaaggggctgacagct

SEQ ID NO: 10059513 - DNA, 22 bp, Homo sapiens
atctattctctacagtagacag

SEQ ID NO: 10059514 - DNA, 22 bp, Homo sapiens
ctgtttccatacaggtttttgg

SEQ ID NO: 10059515 - DNA, 22 bp, Homo sapiens
ctgtttccccatgccctgactc

SEQ ID NO: 10059516 - DNA, 22 bp, Homo sapiens
ctgtttcctaccgtttttcatt

SEQ ID NO: 10059517 - DNA, 22 bp, Homo sapiens
ctgtttccctccagggggtgga

SEQ ID NO: 10059518 - DNA, 22 bp, Homo sapiens
ctgtttccaccttcatggctaa

SEQ ID NO: 10059519 - DNA, 22 bp, Homo sapiens
ctgtttcctgtcttctcactat

SEQ ID NO: 10059520 - DNA, 22 bp, Homo sapiens
cttcatgagtgtacaacctgtg

SEQ ID NO: 10059521 - DNA, 22 bp, Homo sapiens
atctccagtgaggcagattctg

SEQ ID NO: 10059522 - DNA, 22 bp, Homo sapiens
atctccaggcatttcaagagac

SEQ ID NO: 10059523 - DNA, 22 bp, Homo sapiens
atctccagctcgcagagctcct

SEQ ID NO: 10059524 - DNA, 22 bp, Homo sapiens
atctccagcaatggggagctct

SEQ ID NO: 10059525 - DNA, 22 bp, Homo sapiens
atctccagaggagtcatggtct

SEQ ID NO: 10059526 - DNA, 22 bp, Homo sapiens
atagaatgtattatagtacaga

SEQ ID NO: 10059527 - DNA, 22 bp, Homo sapiens
atacagaactctcagttgtata

SEQ ID NO: 10059528 - DNA, 22 bp, Homo sapiens
atacagaacaagcctcacctcc

SEQ ID NO: 10059529 - DNA, 22 bp, Homo sapiens
tactgtgaatacaaaataaatt

SEQ ID NO: 10059530 - DNA, 22 bp, Homo sapiens
taggtacttaagatctcagcta

SEQ ID NO: 10059531 - DNA, 22 bp, Homo sapiens
cagtgggacatgggcactgggc

SEQ ID NO: 10059532 - DNA, 22 bp, Homo sapiens
tcagctttgatctcaggcaatc

SEQ ID NO: 10059533 - DNA, 22 bp, Homo sapiens
tcatgcaagaataataggaagg

SEQ ID NO: 10059534 - DNA, 19 bp, Homo sapiens
tcatgcaatcagtgaactg

SEQ ID NO: 10059535 - DNA, 22 bp, Homo sapiens
catttggaaagagactagagaa

SEQ ID NO: 10059536 - DNA, 22 bp, Homo sapiens
tcggccacggggtttcctccaa

SEQ ID NO: 10059537 - DNA, 22 bp, Homo sapiens
ccagagagctacaaggcataaa

SEQ ID NO: 10059538 - DNA, 22 bp, Homo sapiens
tctccaggaaagacactggact

SEQ ID NO: 10059539 - DNA, 22 bp, Homo sapiens
tctccacaccagaaggagctga

SEQ ID NO: 10059540 - DNA, 22 bp, Homo sapiens
tctgaagttcttaaattagttt

SEQ ID NO: 10059541 - DNA, 22 bp, Homo sapiens
ccagcagagttggtttctggta

SEQ ID NO: 10059542 - DNA, 22 bp, Homo sapiens
tctctgcccatcctcagtccac

SEQ ID NO: 10059543 - DNA, 22 bp, Homo sapiens
tggctcagcgcggcctggtctt

SEQ ID NO: 10059544 - DNA, 22 bp, Homo sapiens
tggctaagctggggaggcctgg

SEQ ID NO: 10059545 - DNA, 22 bp, Homo sapiens
tggctacagtggcatatcaaat

SEQ ID NO: 10059546 - DNA, 22 bp, Homo sapiens
ccctggagctgcttgcatgttg

SEQ ID NO: 10059547 - DNA, 18 bp, Homo sapiens
tcttgcctgcaccctctc

SEQ ID NO: 10059548 - DNA, 22 bp, Homo sapiens
tcttgcctcttcccctttccat

SEQ ID NO: 10059549 - DNA, 20 bp, Homo sapiens
tctgcagataagggaaagac

SEQ ID NO: 10059550 - DNA, 22 bp, Homo sapiens
tctgcagagcattatagcaaaa

SEQ ID NO: 10059551 - DNA, 22 bp, Homo sapiens
tctttcaaagtaacaaccacga

SEQ ID NO: 10059552 - DNA, 22 bp, Homo sapiens
ccaggtaaattacctactgaat

SEQ ID NO: 10059553 - DNA, 22 bp, Homo sapiens
gaggccttgggatgtgccacgg

SEQ ID NO: 10059554 - DNA, 22 bp, Homo sapiens
gacatcatgttctgctaatagt

SEQ ID NO: 10059555 - DNA, 22 bp, Homo sapiens
gagaactcagacgcaggtcatg

SEQ ID NO: 10059556 - DNA, 22 bp, Homo sapiens
cttgcctccctcagctcacagc

SEQ ID NO: 10059557 - DNA, 22 bp, Homo sapiens
cttcagaaataacaacaattac

SEQ ID NO: 10059558 - DNA, 22 bp, Homo sapiens
gaaactctcgcatcctgggaac

SEQ ID NO: 10059559 - DNA, 22 bp, Homo sapiens
ctgtgtgagtgactgcatctca

SEQ ID NO: 10059560 - DNA, 22 bp, Homo sapiens
ctctgtgctcccatgctagtaa

SEQ ID NO: 10059561 - DNA, 22 bp, Homo sapiens
ctggaaagtgcttttctgagag

SEQ ID NO: 10059562 - DNA, 22 bp, Homo sapiens
ctggaaggggcagtctttgggc

SEQ ID NO: 10059563 - DNA, 22 bp, Homo sapiens
ctggaagggagcactgtagaga

SEQ ID NO: 10059564 - DNA, 22 bp, Homo sapiens
ctggaagggaaatctcttggca

SEQ ID NO: 10059565 - DNA, 22 bp, Homo sapiens
ttttgcttttgtaacacagtgt

SEQ ID NO: 10059566 - DNA, 22 bp, Homo sapiens
ctcttcttatggccgtggctga

SEQ ID NO: 10059567 - DNA, 22 bp, Homo sapiens
ttcaaatgcaagttactacttt

SEQ ID NO: 10059568 - DNA, 22 bp, Homo sapiens
cggagtcttgctatgttgccca

SEQ ID NO: 10059569 - DNA, 20 bp, Homo sapiens
ttcaaagtgtatgatatgca

SEQ ID NO: 10059570 - DNA, 22 bp, Homo sapiens
ttcaaatcactttggagcttaa

SEQ ID NO: 10059571 - DNA, 22 bp, Homo sapiens
ccttttgagacttccactgtgt

SEQ ID NO: 10059572 - DNA, 22 bp, Homo sapiens
ttagacaggatgtatgaaagct

SEQ ID NO: 10059573 - DNA, 22 bp, Homo sapiens
ccttcaaactttcattaaccag

SEQ ID NO: 10059574 - DNA, 18 bp, Homo sapiens
ctcagggtgaccaatgca

SEQ ID NO: 10059575 - DNA, 22 bp, Homo sapiens
gctactttgcagctagctagga

SEQ ID NO: 10059576 - DNA, 22 bp, Homo sapiens
gctcagggagcgatttaccatg

SEQ ID NO: 10059577 - DNA, 22 bp, Homo sapiens
gcctggagaaaggaaggtggga

SEQ ID NO: 10059578 - DNA, 23 bp, Homo sapiens
gcctggagaaaagctgcagttca

SEQ ID NO: 10059579 - DNA, 22 bp, Homo sapiens
gcctggagcccagtgtggggct

SEQ ID NO: 10059580 - DNA, 16 bp, Homo sapiens
gcctggagtggcaggg

SEQ ID NO: 10059581 - DNA, 22 bp, Homo sapiens
gcctggagtgcagtggcgtgat

SEQ ID NO: 10059582 - DNA, 22 bp, Homo sapiens
ggctcagaaacctctggtgtct

SEQ ID NO: 10059583 - DNA, 22 bp, Homo sapiens
ggctcagagacctgcgatctga

SEQ ID NO: 10059584 - DNA, 22 bp, Homo sapiens
ggctcagatggtttgttctaga

SEQ ID NO: 10059585 - DNA, 22 bp, Homo sapiens
ggcccaggctggagtgcagtgg

SEQ ID NO: 10059586 - DNA, 22 bp, Homo sapiens
ggcagtgagtcccggagaggcc

SEQ ID NO: 10059587 - DNA, 22 bp, Homo sapiens
gtcaaacaaattaacatatcca

SEQ ID NO: 10059588 - DNA, 22 bp, Homo sapiens
gtcaaatatactaagaggtaaa

SEQ ID NO: 10059589 - DNA, 22 bp, Homo sapiens
gtctaaagcccttagaatagta

SEQ ID NO: 10059590 - DNA, 22 bp, Homo sapiens
tagtttcctaggctgtattgtt

SEQ ID NO: 10059591 - DNA, 18 bp, Homo sapiens
tcaaactgtcattggtga

SEQ ID NO: 10059592 - DNA, 22 bp, Homo sapiens
tcaaactgttcagaactccttt

SEQ ID NO: 10059593 - DNA, 22 bp, Homo sapiens
tcaaatagttgacattaacttg

SEQ ID NO: 10059594 - DNA, 22 bp, Homo sapiens
tatcagaagacttacagtatcg

SEQ ID NO: 10059595 - DNA, 22 bp, Homo sapiens
tacaagagacaccagggaggct

SEQ ID NO: 10059596 - DNA, 22 bp, Homo sapiens
tacaagaatgtcttaaaagctc

SEQ ID NO: 10059597 - DNA, 22 bp, Homo sapiens
tacaacatttacgttaggctgt

SEQ ID NO: 10059598 - DNA, 22 bp, Homo sapiens
tacaacatgtggtcctttatga

SEQ ID NO: 10059599 - DNA, 22 bp, Homo sapiens
tacacacatgcatttgccttat

SEQ ID NO: 10059600 - DNA, 22 bp, Homo sapiens
tacacacagaggccatgggatt

SEQ ID NO: 10059601 - DNA, 22 bp, Homo sapiens
tacacataaaatgctcatggta

SEQ ID NO: 10059602 - DNA, 22 bp, Homo sapiens
tacacatacattgcttacaagg

SEQ ID NO: 10059603 - DNA, 22 bp, Homo sapiens
tacacatacaccaatgtggtca

SEQ ID NO: 10059604 - DNA, 22 bp, Homo sapiens
tacacagaacctggtgtacagt

SEQ ID NO: 10059605 - DNA, 22 bp, Homo sapiens
tacacagtagagtataatgcgt

SEQ ID NO: 10059606 - DNA, 22 bp, Homo sapiens
tacacataggtctgaataaaaa

SEQ ID NO: 10059607 - DNA, 22 bp, Homo sapiens
tacacataggagggtaataaaa

SEQ ID NO: 10059608 - DNA, 22 bp, Homo sapiens
tacagtagtaagaatgccttat

SEQ ID NO: 10059609 - DNA, 22 bp, Homo sapiens
tacagtgactggactttgtcat

SEQ ID NO: 10059610 - DNA, 22 bp, Homo sapiens
tacagtgatagagagtagctat

SEQ ID NO: 10059611 - DNA, 22 bp, Homo sapiens
tactgttttctataatggctgt

SEQ ID NO: 10059612 - DNA, 22 bp, Homo sapiens
tactgtttcaagccctcacaga

SEQ ID NO: 10059613 - DNA, 22 bp, Homo sapiens
tactgttttctttatagtacag

SEQ ID NO: 10059614 - DNA, 22 bp, Homo sapiens
tactctcagggttagtacagga

SEQ ID NO: 10059615 - DNA, 22 bp, Homo sapiens
taccatttctacatatcttgtc

SEQ ID NO: 10059616 - DNA, 22 bp, Homo sapiens
taccattttgaaacatttcatc

SEQ ID NO: 10059617 - DNA, 22 bp, Homo sapiens
tactacatacagaatttagaga

SEQ ID NO: 10059618 - DNA, 22 bp, Homo sapiens
taaaagaccctctagagtccca

SEQ ID NO: 10059619 - DNA, 22 bp, Homo sapiens
taagacatccgttgcttataat

SEQ ID NO: 10059620 - DNA, 22 bp, Homo sapiens
gtttcttttaaaatatgtagac

SEQ ID NO: 10059621 - DNA, 21 bp, Homo sapiens
gtgtttcctgtttatggcttg

SEQ ID NO: 10059622 - DNA, 22 bp, Homo sapiens
tcactgcaacctccacctcctg

SEQ ID NO: 10059623 - DNA, 22 bp, Homo sapiens
tcactgcaacctccacctcccg

SEQ ID NO: 10059624 - DNA, 22 bp, Homo sapiens
tcagaacagctctcagatatcc

SEQ ID NO: 10059625 - DNA, 22 bp, Homo sapiens
tcagaaaccccaacaatggaga

SEQ ID NO: 10059626 - DNA, 22 bp, Homo sapiens
tcaacatacatacatggtcagg

SEQ ID NO: 10059627 - DNA, 23 bp, Homo sapiens
tcacataatccttcatccacagg

SEQ ID NO: 10059628 - DNA, 22 bp, Homo sapiens
tcagacacagatgagacaagga

SEQ ID NO: 10059629 - DNA, 22 bp, Homo sapiens
tcagacagaaagatgagtatgg

SEQ ID NO: 10059630 - DNA, 23 bp, Homo sapiens
tccaaggttgttgtggaaggggc

SEQ ID NO: 10059631 - DNA, 22 bp, Homo sapiens
tccaaatacatttactgtattt

SEQ ID NO: 10059632 - DNA, 22 bp, Homo sapiens
tccaaagaacattgctgagacc

SEQ ID NO: 10059633 - DNA, 22 bp, Homo sapiens
tccaaacaccctccatgctgca

SEQ ID NO: 10059634 - DNA, 21 bp, Homo sapiens
tccaaacctgtctctggctct

SEQ ID NO: 10059635 - DNA, 22 bp, Homo sapiens
tcatttttttccggtaggaata

SEQ ID NO: 10059636 - DNA, 22 bp, Homo sapiens
tcatagaaatgtggccagaaac

SEQ ID NO: 10059637 - DNA, 22 bp, Homo sapiens
tcatgaaaatagatcagaaatt

SEQ ID NO: 10059638 - DNA, 22 bp, Homo sapiens
tcataaagtgaaggatgatggg

SEQ ID NO: 10059639 - DNA, 22 bp, Homo sapiens
tcataaagcttgcctgcagtgt

SEQ ID NO: 10059640 - DNA, 22 bp, Homo sapiens
tcataaagttctaagaattgta

SEQ ID NO: 10059641 - DNA, 22 bp, Homo sapiens
tcataaagttgttttaatggga

SEQ ID NO: 10059642 - DNA, 22 bp, Homo sapiens
tcctgaggcctctgtgatgtga

SEQ ID NO: 10059643 - DNA, 22 bp, Homo sapiens
tcctgaggctaaagtgcagtgg

SEQ ID NO: 10059644 - DNA, 22 bp, Homo sapiens
tcctgaggccctgttagggtct

SEQ ID NO: 10059645 - DNA, 22 bp, Homo sapiens
tcctgaggcacaatcctagaat

SEQ ID NO: 10059646 - DNA, 22 bp, Homo sapiens
tcctgaggagaagagtgctagg

SEQ ID NO: 10059647 - DNA, 22 bp, Homo sapiens
tcctgaggatggttgaagtgca

SEQ ID NO: 10059648 - DNA, 22 bp, Homo sapiens
tcctgaggactaacaggaagga

SEQ ID NO: 10059649 - DNA, 22 bp, Homo sapiens
tcctgaggaccctgtcaggggc

SEQ ID NO: 10059650 - DNA, 22 bp, Homo sapiens
tccaggctagagtgcagtggcc

SEQ ID NO: 10059651 - DNA, 22 bp, Homo sapiens
tccaggctggagtgcagtggca

SEQ ID NO: 10059652 - DNA, 22 bp, Homo sapiens
tccaggctggagtgcagtggcg

SEQ ID NO: 10059653 - DNA, 22 bp, Homo sapiens
tccaggtgtatttactgaagta

SEQ ID NO: 10059654 - DNA, 19 bp, Homo sapiens
tccaggtggagagacaccc

SEQ ID NO: 10059655 - DNA, 22 bp, Homo sapiens
tccctggacaacagacttcact

SEQ ID NO: 10059656 - DNA, 20 bp, Homo sapiens
tccctggaggtggtggcatc

SEQ ID NO: 10059657 - DNA, 22 bp, Homo sapiens
tcctcaggtcaaagcaggagaa

SEQ ID NO: 10059658 - DNA, 22 bp, Homo sapiens
ttcttcaaaacaacactggcct

SEQ ID NO: 10059659 - DNA, 22 bp, Homo sapiens
ttccttgttcctaggagatcaa

SEQ ID NO: 10059660 - DNA, 19 bp, Homo sapiens
ttctctgctacattctcag

SEQ ID NO: 10059661 - DNA, 22 bp, Homo sapiens
ttctctgctacatactagggct

SEQ ID NO: 10059662 - DNA, 22 bp, Homo sapiens
ttctctgcagctcctggctggg

SEQ ID NO: 10059663 - DNA, 22 bp, Homo sapiens
ttcctgagggccccagaggagg

SEQ ID NO: 10059664 - DNA, 22 bp, Homo sapiens
ttcctgagcaccagacactgca

SEQ ID NO: 10059665 - DNA, 23 bp, Homo sapiens
ttcctgagtgctggagagagtgc

SEQ ID NO: 10059666 - DNA, 22 bp, Homo sapiens
ttcaaacagatgactctgctct

SEQ ID NO: 10059667 - DNA, 22 bp, Homo sapiens
ttcaaactctgagtagttctgc

SEQ ID NO: 10059668 - DNA, 22 bp, Homo sapiens
ttcagagaagcaaaggcagatt

SEQ ID NO: 10059669 - DNA, 22 bp, Homo sapiens
ttcagagagtttgtgagtcctt

SEQ ID NO: 10059670 - DNA, 22 bp, Homo sapiens
ttcaaacttaaggagcagcaga

SEQ ID NO: 10059671 - DNA, 20 bp, Homo sapiens
ttcaaagaccctcaggtcca

SEQ ID NO: 10059672 - DNA, 20 bp, Homo sapiens
ttggacagacgcattgacac

SEQ ID NO: 10059673 - DNA, 22 bp, Homo sapiens
ttggaaagggaggaatgtagac

SEQ ID NO: 10059674 - DNA, 22 bp, Homo sapiens
ttgctctgtcagggcctcagtc

SEQ ID NO: 10059675 - DNA, 22 bp, Homo sapiens
ttgtacagaccctgaaaagctc

SEQ ID NO: 10059676 - DNA, 22 bp, Homo sapiens
ttgtacagaaaaaattcttggt

SEQ ID NO: 10059677 - DNA, 23 bp, Homo sapiens
ttgtcctgccgatctctgagaat

SEQ ID NO: 10059678 - DNA, 22 bp, Homo sapiens
ttgtcatgatccttctgttagg

SEQ ID NO: 10059679 - DNA, 22 bp, Homo sapiens
ttgggcagtgattagttcatga

SEQ ID NO: 10059680 - DNA, 22 bp, Homo sapiens
ttgggacatctggcatacagtt

SEQ ID NO: 10059681 - DNA, 22 bp, Homo sapiens
ttggcatcagtgtaggacctgt

SEQ ID NO: 10059682 - DNA, 22 bp, Homo sapiens
tttcacacccactaggactgtt

SEQ ID NO: 10059683 - DNA, 22 bp, Homo sapiens
tttcaagaagcaaattaaagtc

SEQ ID NO: 10059684 - DNA, 22 bp, Homo sapiens
tttcaagagaaaactaacctat

SEQ ID NO: 10059685 - DNA, 22 bp, Homo sapiens
tttacagtctgtctagcaatgt

SEQ ID NO: 10059686 - DNA, 22 bp, Homo sapiens
tttgaggttagctagcagatca

SEQ ID NO: 10059687 - DNA, 22 bp, Homo sapiens
tttgaggacattttagaaagtt

SEQ ID NO: 10059688 - DNA, 22 bp, Homo sapiens
tttcttttgctgagaggggcac

SEQ ID NO: 10059689 - DNA, 22 bp, Homo sapiens
tttcttttgaatagtgtgtggt

SEQ ID NO: 10059690 - DNA, 22 bp, Homo sapiens
ttttcttatggtgaagcacaaa

SEQ ID NO: 10059691 - DNA, 22 bp, Homo sapiens
tttttagattactcagccacca

SEQ ID NO: 10059692 - DNA, 22 bp, Homo sapiens
tttttagagtgttaccagtata

SEQ ID NO: 10059693 - DNA, 23 bp, Homo sapiens
aatgtatgttagtatcttagaga

SEQ ID NO: 10059694 - DNA, 22 bp, Homo sapiens
aatgtatgagcgtgaaagcact

SEQ ID NO: 10059695 - DNA, 22 bp, Homo sapiens
agacatgccaagaaacccagtg

SEQ ID NO: 10059696 - DNA, 22 bp, Homo sapiens
agacatcttgcacacatatact

SEQ ID NO: 10059697 - DNA, 18 bp, Homo sapiens
acacagtggatgcctggt

SEQ ID NO: 10059698 - DNA, 22 bp, Homo sapiens
acacagtattgtgactataact

SEQ ID NO: 10059699 - DNA, 22 bp, Homo sapiens
acacagtgtcagggcaggggcc

SEQ ID NO: 10059700 - DNA, 22 bp, Homo sapiens
acacacaactcattgtgtaata

SEQ ID NO: 10059701 - DNA, 22 bp, Homo sapiens
acagagggggccttggagtgca

SEQ ID NO: 10059702 - DNA, 22 bp, Homo sapiens
acctctgctcaagacccctccg

SEQ ID NO: 10059703 - DNA, 22 bp, Homo sapiens
aaggcaactgtaaaacatgcac

SEQ ID NO: 10059704 - DNA, 22 bp, Homo sapiens
acatgaatgcagccataacact

SEQ ID NO: 10059705 - DNA, 22 bp, Homo sapiens
agaactgtcacgagtgacaaag

SEQ ID NO: 10059706 - DNA, 22 bp, Homo sapiens
agaagccaccagctgaggaaga

SEQ ID NO: 10059707 - DNA, 22 bp, Homo sapiens
aagtgtgagacacacaaaatta

SEQ ID NO: 10059708 - DNA, 22 bp, Homo sapiens
actgtacaaatattgcaaaata

SEQ ID NO: 10059709 - DNA, 22 bp, Homo sapiens
aaagtctgaaagatgctaacat

SEQ ID NO: 10059710 - DNA, 20 bp, Homo sapiens
aaagtctgtttatctctgga

SEQ ID NO: 10059711 - DNA, 20 bp, Homo sapiens
aaagtctcaacagctgagaa

SEQ ID NO: 10059712 - DNA, 22 bp, Homo sapiens
aaagtcctagcgatccacagaa

SEQ ID NO: 10059713 - DNA, 22 bp, Homo sapiens
aaagttacacgactatttatgt

SEQ ID NO: 10059714 - DNA, 19 bp, Homo sapiens
aaatatcagagagatgata

SEQ ID NO: 10059715 - DNA, 20 bp, Homo sapiens
aagaagccgggaaggcaggc

SEQ ID NO: 10059716 - DNA, 22 bp, Homo sapiens
aaatatttgtctgaggcggttg

SEQ ID NO: 10059717 - DNA, 22 bp, Homo sapiens
aaaggacatgtcaatatcaggc

SEQ ID NO: 10059718 - DNA, 22 bp, Homo sapiens
aaactgtgagctagtaaatagg

SEQ ID NO: 10059719 - DNA, 22 bp, Homo sapiens
aaatacagagttatggacctca

SEQ ID NO: 10059720 - DNA, 20 bp, Homo sapiens
acacatatagcagcataaac

SEQ ID NO: 10059721 - DNA, 22 bp, Homo sapiens
acacataagcctaatcatctcc

SEQ ID NO: 10059722 - DNA, 22 bp, Homo sapiens
acacataagcctaatcatctcc

SEQ ID NO: 10059723 - DNA, 23 bp, Homo sapiens
acagacaacactgatgagagaaa

SEQ ID NO: 10059724 - DNA, 22 bp, Homo sapiens
acagctgctctatatctcagcc

SEQ ID NO: 10059725 - DNA, 22 bp, Homo sapiens
aagtgctgggattacaggcatg

SEQ ID NO: 10059726 - DNA, 22 bp, Homo sapiens
aagtgctgagactacaggcatg

SEQ ID NO: 10059727 - DNA, 22 bp, Homo sapiens
aacagtgtctgtggttaaaggt

SEQ ID NO: 10059728 - DNA, 22 bp, Homo sapiens
aagtctgatcatttcttctata

SEQ ID NO: 10059729 - DNA, 22 bp, Homo sapiens
aagtctgagagaaactctctca

SEQ ID NO: 10059730 - DNA, 22 bp, Homo sapiens
aagtaactaaagatatccattt

SEQ ID NO: 10059731 - DNA, 22 bp, Homo sapiens
aatatccattgggagcaaatgg

SEQ ID NO: 10059732 - DNA, 22 bp, Homo sapiens
aatatttcaaaaggaaacacag

SEQ ID NO: 10059733 - DNA, 22 bp, Homo sapiens
aatattgtttcaagatcacaga

SEQ ID NO: 10059734 - DNA, 22 bp, Homo sapiens
atagaagcaagaacagaatgga

SEQ ID NO: 10059735 - DNA, 22 bp, Homo sapiens
atacacagcgatgagaggaggc

SEQ ID NO: 10059736 - DNA, 22 bp, Homo sapiens
atacaatgaagtatagatgaaa

SEQ ID NO: 10059737 - DNA, 17 bp, Homo sapiens
agaaactgaggctcagt

SEQ ID NO: 10059738 - DNA, 22 bp, Homo sapiens
atatagaatacacagggaaagt

SEQ ID NO: 10059739 - DNA, 22 bp, Homo sapiens
agaagcactagagggtatggaa

SEQ ID NO: 10059740 - DNA, 22 bp, Homo sapiens
agaagccatgtttagtaggatg

SEQ ID NO: 10059741 - DNA, 22 bp, Homo sapiens
agaagccattctcagttcctga

SEQ ID NO: 10059742 - DNA, 21 bp, Homo sapiens
agaagccatttgttaggactt

SEQ ID NO: 10059743 - DNA, 21 bp, Homo sapiens
agaagccatgtggtggagaac

SEQ ID NO: 10059744 - DNA, 22 bp, Homo sapiens
agaagccatagtctgggaggca

SEQ ID NO: 10059745 - DNA, 22 bp, Homo sapiens
actctgctcaaagtcctgaggc

SEQ ID NO: 10059746 - DNA, 22 bp, Homo sapiens
agtcacttggattagcaattct

SEQ ID NO: 10059747 - DNA, 17 bp, Homo sapiens
acagtgagaagtcatct

SEQ ID NO: 10059748 - DNA, 21 bp, Homo sapiens
acagtgagaaataaatggaaa

SEQ ID NO: 10059749 - DNA, 22 bp, Homo sapiens
acagtggatgtgatgtccaggt

SEQ ID NO: 10059750 - DNA, 22 bp, Homo sapiens
acaggaactgttatctcagatg

SEQ ID NO: 10059751 - DNA, 22 bp, Homo sapiens
accagaagctggagcacaagga

SEQ ID NO: 10059752 - DNA, 22 bp, Homo sapiens
accactggcctggtggggacca

SEQ ID NO: 10059753 - DNA, 22 bp, Homo sapiens
agggcacaagactctgagcccc

SEQ ID NO: 10059754 - DNA, 22 bp, Homo sapiens
attgtataagtctatttacaat

SEQ ID NO: 10059755 - DNA, 22 bp, Homo sapiens
attcaaacaggaagaaatcatt

SEQ ID NO: 10059756 - DNA, 22 bp, Homo sapiens
attcaaacaggccaattgacct

SEQ ID NO: 10059757 - DNA, 22 bp, Homo sapiens
attcaaaccccatagacaactt

SEQ ID NO: 10059758 - DNA, 22 bp, Homo sapiens
attcaaactgtgttaggcagca

SEQ ID NO: 10059759 - DNA, 22 bp, Homo sapiens
attcaaacctcatttattgttc

SEQ ID NO: 10059760 - DNA, 22 bp, Homo sapiens
attctaatggcagagactcctg

SEQ ID NO: 10059761 - DNA, 22 bp, Homo sapiens
attctaatgccctggccccagc

SEQ ID NO: 10059762 - DNA, 22 bp, Homo sapiens
attctaattagttctacatgtt

SEQ ID NO: 10059763 - DNA, 22 bp, Homo sapiens
attctacaaaagaactggatct

SEQ ID NO: 10059764 - DNA, 22 bp, Homo sapiens
atgttctacagatggaaagggg

SEQ ID NO: 10059765 - DNA, 22 bp, Homo sapiens
agacatatattgcaattcactg

SEQ ID NO: 10059766 - DNA, 22 bp, Homo sapiens
agacataagtgctatgacattg

SEQ ID NO: 10059767 - DNA, 22 bp, Homo sapiens
agacagtgtgtgtatatatggt

SEQ ID NO: 10059768 - DNA, 22 bp, Homo sapiens
agacataaacttactgaaatac

SEQ ID NO: 10059769 - DNA, 19 bp, Homo sapiens
agacataaagagtttgcaa

SEQ ID NO: 10059770 - DNA, 22 bp, Homo sapiens
agccaaagagaccccatatcca

SEQ ID NO: 10059771 - DNA, 22 bp, Homo sapiens
cagctgccatgacatgtcctgc

SEQ ID NO: 10059772 - DNA, 22 bp, Homo sapiens
cagctgccagcttctctccatc

SEQ ID NO: 10059773 - DNA, 18 bp, Homo sapiens
cagctgccagctcatgga

SEQ ID NO: 10059774 - DNA, 22 bp, Homo sapiens
cagctgcccctccagggctggg

SEQ ID NO: 10059775 - DNA, 22 bp, Homo sapiens
cagcccagacaccatcattcta

SEQ ID NO: 10059776 - DNA, 22 bp, Homo sapiens
cagaggaggcggtatacactgc

SEQ ID NO: 10059777 - DNA, 22 bp, Homo sapiens
atggctttcagatttctatgtt

SEQ ID NO: 10059778 - DNA, 17 bp, Homo sapiens
atgtgtctgagtgtcct

SEQ ID NO: 10059779 - DNA, 22 bp, Homo sapiens
atgtgaagcttgtgctaacata

SEQ ID NO: 10059780 - DNA, 22 bp, Homo sapiens
atgtctatgttctttactgtgt

SEQ ID NO: 10059781 - DNA, 22 bp, Homo sapiens
atgtccttggagtccactttcc

SEQ ID NO: 10059782 - DNA, 22 bp, Homo sapiens
gacacatatgcgtatagtttag

SEQ ID NO: 10059783 - DNA, 22 bp, Homo sapiens
gaatattttcagtacagatggt

SEQ ID NO: 10059784 - DNA, 22 bp, Homo sapiens
atgcacaggaccacacataatg

SEQ ID NO: 10059785 - DNA, 22 bp, Homo sapiens
ctttctgatgtaaggaactagg

SEQ ID NO: 10059786 - DNA, 22 bp, Homo sapiens
ctttctgattttaagctctaat

SEQ ID NO: 10059787 - DNA, 22 bp, Homo sapiens
ctttccaggaatcctcacagcc

SEQ ID NO: 10059788 - DNA, 22 bp, Homo sapiens
caaatgctactaataggcaagt

SEQ ID NO: 10059789 - DNA, 20 bp, Homo sapiens
caaagcagtaggataaaaat

SEQ ID NO: 10059790 - DNA, 22 bp, Homo sapiens
gtctgcttttctgccctttcat

SEQ ID NO: 10059791 - DNA, 22 bp, Homo sapiens
gtctgtgcagttactagctggt

SEQ ID NO: 10059792 - DNA, 22 bp, Homo sapiens
ggtctgagtggtgctgactcag

SEQ ID NO: 10059793 - DNA, 22 bp, Homo sapiens
cagaaaaggaagagctatgtaa

SEQ ID NO: 10059794 - DNA, 22 bp, Homo sapiens
cagaaagccctatgtacagtgg

SEQ ID NO: 10059795 - DNA, 21 bp, Homo sapiens
ggccaacatggtctcatctct

SEQ ID NO: 10059796 - DNA, 22 bp, Homo sapiens
cacatacaaggcacactggagg

SEQ ID NO: 10059797 - DNA, 22 bp, Homo sapiens
cacatacatacgtatgtataca

SEQ ID NO: 10059798 - DNA, 22 bp, Homo sapiens
cacatacaatggtgttatttgg

SEQ ID NO: 10059799 - DNA, 19 bp, Homo sapiens
cacatacagaaaagagtaa

SEQ ID NO: 10059800 - DNA, 22 bp, Homo sapiens
cacatacattcatgttactcta

SEQ ID NO: 10059801 - DNA, 22 bp, Homo sapiens
cacatacatgcacacctaaata

SEQ ID NO: 10059802 - DNA, 22 bp, Homo sapiens
ggaggtggaggttgcaatgagc

SEQ ID NO: 10059803 - DNA, 22 bp, Homo sapiens
cacatacttgtgtgtacatatg

SEQ ID NO: 10059804 - DNA, 22 bp, Homo sapiens
ccacagaattctgtctccagga

SEQ ID NO: 10059805 - DNA, 22 bp, Homo sapiens
ccacagaatgatgacacttcag

SEQ ID NO: 10059806 - DNA, 22 bp, Homo sapiens
catccaaagcaaatatcttaaa

SEQ ID NO: 10059807 - DNA, 22 bp, Homo sapiens
catacaagcgttcaatagatgt

SEQ ID NO: 10059808 - DNA, 22 bp, Homo sapiens
catacagagaaggataataaag

SEQ ID NO: 10059809 - DNA, 22 bp, Homo sapiens
catacatactgagtggactgat

SEQ ID NO: 10059810 - DNA, 22 bp, Homo sapiens
caggactggctcgcagtgggtg

SEQ ID NO: 10059811 - DNA, 22 bp, Homo sapiens
agctgtatttgtgaatatttaa

SEQ ID NO: 10059812 - DNA, 22 bp, Homo sapiens
agcttactgggcagtaaagatt

SEQ ID NO: 10059813 - DNA, 22 bp, Homo sapiens
cctcttcacctcgggcacactg

SEQ ID NO: 10059814 - DNA, 22 bp, Homo sapiens
ctacagaattcaacaaatggtt

SEQ ID NO: 10059815 - DNA, 22 bp, Homo sapiens
ctacagaatggagggtcagaga

SEQ ID NO: 10059816 - DNA, 22 bp, Homo sapiens
ctacagaatctacctcaagcca

SEQ ID NO: 10059817 - DNA, 22 bp, Homo sapiens
aggtacagggtgaaagtttatg

SEQ ID NO: 10059818 - DNA, 22 bp, Homo sapiens
ctgaggagaggtggcctgtgtt

SEQ ID NO: 10059819 - DNA, 21 bp, Homo sapiens
ctctgctgagtcctaggattc

SEQ ID NO: 10059820 - DNA, 22 bp, Homo sapiens
ctctgctgagccagagtcccca

SEQ ID NO: 10059821 - DNA, 22 bp, Homo sapiens
ctctgcctgtgtcgccaccaca

SEQ ID NO: 10059822 - DNA, 22 bp, Homo sapiens
atcagaatggagcccacatggt

SEQ ID NO: 10059823 - DNA, 22 bp, Homo sapiens
ctggagaagccaaactagtcac

SEQ ID NO: 10059824 - DNA, 17 bp, Homo sapiens
ctggagaagcctgtgga

SEQ ID NO: 10059825 - DNA, 22 bp, Homo sapiens
atacagtagggaccatgtctga

SEQ ID NO: 10059826 - DNA, 22 bp, Homo sapiens
atacagtagacaatctcatgaa

SEQ ID NO: 10059827 - DNA, 23 bp, Homo sapiens
atacatacagtcttactgacttt

SEQ ID NO: 10059828 - DNA, 22 bp, Homo sapiens
atacatacgtacatacgtatgt

SEQ ID NO: 10059829 - DNA, 22 bp, Homo sapiens
atactacattattagagcctgg

SEQ ID NO: 10059830 - DNA, 22 bp, Homo sapiens
atacaaaggaacacaggcatgt

SEQ ID NO: 10059831 - DNA, 22 bp, Homo sapiens
ctgaggagctgaaggccctcca

SEQ ID NO: 10059832 - DNA, 22 bp, Homo sapiens
ctgaggagcagctggcccgcta

SEQ ID NO: 10059833 - DNA, 22 bp, Homo sapiens
ctgaggagcaaccccgtgccct

SEQ ID NO: 10059834 - DNA, 22 bp, Homo sapiens
catctgttctatccacgttgct

SEQ ID NO: 10059835 - DNA, 22 bp, Homo sapiens
catctgctgctgaagccagcat

SEQ ID NO: 10059836 - DNA, 22 bp, Homo sapiens
catgcagtctggagccttctgt

SEQ ID NO: 10059837 - DNA, 22 bp, Homo sapiens
catggcaggtgcagattctgtg

SEQ ID NO: 10059838 - DNA, 22 bp, Homo sapiens
tccctggaacagagagacaacg

SEQ ID NO: 10059839 - DNA, 22 bp, Homo sapiens
tctaataaataaatgctctagg

SEQ ID NO: 10059840 - DNA, 22 bp, Homo sapiens
tccttgtgctgagggtgttgct

SEQ ID NO: 10059841 - DNA, 22 bp, Homo sapiens
ccaaggagcaaggctcaacaag

SEQ ID NO: 10059842 - DNA, 22 bp, Homo sapiens
ccaaggctggagtgcagtggcg

SEQ ID NO: 10059843 - DNA, 22 bp, Homo sapiens
ccacagaaagttgtctagagta

SEQ ID NO: 10059844 - DNA, 22 bp, Homo sapiens
ccacagaaaataaagcacgatt

SEQ ID NO: 10059845 - DNA, 22 bp, Homo sapiens
caggtacaaagctactgcctga

SEQ ID NO: 10059846 - DNA, 22 bp, Homo sapiens
taagtgaaataagtcagataca

SEQ ID NO: 10059847 - DNA, 22 bp, Homo sapiens
taagtatgttagaaaatcaagt

SEQ ID NO: 10059848 - DNA, 22 bp, Homo sapiens
tgagacgaagtcttgctctgtt

SEQ ID NO: 10059849 - DNA, 22 bp, Homo sapiens
ccaggtgtagcactgctcacag

SEQ ID NO: 10059850 - DNA, 20 bp, Homo sapiens
tgagaaggggtcagctgtac

SEQ ID NO: 10059851 - DNA, 22 bp, Homo sapiens
tgagaaggcctgtgtgacaggg

SEQ ID NO: 10059852 - DNA, 22 bp, Homo sapiens
tgacagtgcgggtacatcatag

SEQ ID NO: 10059853 - DNA, 22 bp, Homo sapiens
tgacagtgtttgcacttcaggt

SEQ ID NO: 10059854 - DNA, 23 bp, Homo sapiens
tgacaacagctctcagccatgtc

SEQ ID NO: 10059855 - DNA, 22 bp, Homo sapiens
tgacaacatcatttttgtgtgg

SEQ ID NO: 10059856 - DNA, 20 bp, Homo sapiens
tgacaacatgccttttgctt

SEQ ID NO: 10059857 - DNA, 22 bp, Homo sapiens
tgacaacattgagttatgtgca

SEQ ID NO: 10059858 - DNA, 21 bp, Homo sapiens
tgacaacagaactgggcaagc

SEQ ID NO: 10059859 - DNA, 22 bp, Homo sapiens
tgacaacagccatcacttttag

SEQ ID NO: 10059860 - DNA, 22 bp, Homo sapiens
tgacaacaaggatcctgcctgg

SEQ ID NO: 10059861 - DNA, 20 bp, Homo sapiens
tgacaacaaaatggtaattt

SEQ ID NO: 10059862 - DNA, 22 bp, Homo sapiens
tctcagaagtgatcaggatgtt

SEQ ID NO: 10059863 - DNA, 22 bp, Homo sapiens
tctcagaatccttgcccaggtg

SEQ ID NO: 10059864 - DNA, 22 bp, Homo sapiens
tctgctttcaaattcacttagt

SEQ ID NO: 10059865 - DNA, 22 bp, Homo sapiens
tctgctttagtgcaaagtctta

SEQ ID NO: 10059866 - DNA, 22 bp, Homo sapiens
tctgctttgaccttcttgatgc

SEQ ID NO: 10059867 - DNA, 22 bp, Homo sapiens
tctgctttgctgcctcctgatc

SEQ ID NO: 10059868 - DNA, 22 bp, Homo sapiens
ccctgaggaccaggaaggaggg

SEQ ID NO: 10059869 - DNA, 22 bp, Homo sapiens
tgctggctttttgtgtcaaaga

SEQ ID NO: 10059870 - DNA, 22 bp, Homo sapiens
cccaggagacctagatctgttt

SEQ ID NO: 10059871 - DNA, 22 bp, Homo sapiens
cccagggtccctgctctctgtg

SEQ ID NO: 10059872 - DNA, 22 bp, Homo sapiens
cccaggctggagtgcaatggtg

SEQ ID NO: 10059873 - DNA, 22 bp, Homo sapiens
cccaggctggagtgcaatggca

SEQ ID NO: 10059874 - DNA, 22 bp, Homo sapiens
tgccctggttacactggagtcc

SEQ ID NO: 10059875 - DNA, 22 bp, Homo sapiens
ccctgtggggtccgcctgtccg

SEQ ID NO: 10059876 - DNA, 22 bp, Homo sapiens
cctagaggctgcaaggagaggc

SEQ ID NO: 10059877 - DNA, 22 bp, Homo sapiens
cctctggacttgggacagtgag

SEQ ID NO: 10059878 - DNA, 22 bp, Homo sapiens
cctctggagtcagaccagcttg

SEQ ID NO: 10059879 - DNA, 22 bp, Homo sapiens
tttgtacatataaatcttgtat

SEQ ID NO: 10059880 - DNA, 22 bp, Homo sapiens
tttgtacactgtctactatgaa

SEQ ID NO: 10059881 - DNA, 22 bp, Homo sapiens
ctgagcctccatttcatcaggt

SEQ ID NO: 10059882 - DNA, 22 bp, Homo sapiens
ctctccaggctgggacaggacc

SEQ ID NO: 10059883 - DNA, 22 bp, Homo sapiens
ctctccaggagctcagagtcta

SEQ ID NO: 10059884 - DNA, 22 bp, Homo sapiens
ctctccaggggtagatgccttc

SEQ ID NO: 10059885 - DNA, 21 bp, Homo sapiens
ctctccaggtaggataaatgt

SEQ ID NO: 10059886 - DNA, 22 bp, Homo sapiens
ctctccagtcatattctcagtc

SEQ ID NO: 10059887 - DNA, 22 bp, Homo sapiens
ctctccaggttagagcacttat

SEQ ID NO: 10059888 - DNA, 22 bp, Homo sapiens
ctctccagtcaggaactctgac

SEQ ID NO: 10059889 - DNA, 22 bp, Homo sapiens
ctccaaatacaatattgttgtt

SEQ ID NO: 10059890 - DNA, 19 bp, Homo sapiens
tgttcagatatgtcagctt

SEQ ID NO: 10059891 - DNA, 22 bp, Homo sapiens
ctatatacttttcacagatgtt

SEQ ID NO: 10059892 - DNA, 22 bp, Homo sapiens
ctatggctccttctctactggg

SEQ ID NO: 10059893 - DNA, 22 bp, Homo sapiens
ctatggctcaattctagtggtt

SEQ ID NO: 10059894 - DNA, 22 bp, Homo sapiens
ctcacaggtaccagcaccctcc

SEQ ID NO: 10059895 - DNA, 22 bp, Homo sapiens
ctcacagatgtcctggcacttc

SEQ ID NO: 10059896 - DNA, 22 bp, Homo sapiens
cgtatacatgaagacattgctg

SEQ ID NO: 10059897 - DNA, 22 bp, Homo sapiens
ctaaagtgccaggaatacaggt

SEQ ID NO: 10059898 - DNA, 22 bp, Homo sapiens
gaatatattggtgaaaatagtt

SEQ ID NO: 10059899 - DNA, 22 bp, Homo sapiens
gaagaggactgtggcatcctag

SEQ ID NO: 10059900 - DNA, 22 bp, Homo sapiens
cttcaaacccagattaaatgca

SEQ ID NO: 10059901 - DNA, 22 bp, Homo sapiens
ctgccactttggagtgctcaga

SEQ ID NO: 10059902 - DNA, 22 bp, Homo sapiens
gtacatttatttttgcagcata

SEQ ID NO: 10059903 - DNA, 22 bp, Homo sapiens
gtacattttactttgtttgaat

SEQ ID NO: 10059904 - DNA, 22 bp, Homo sapiens
gtccaagagtcaagaagggggc

SEQ ID NO: 10059905 - DNA, 22 bp, Homo sapiens
ggtcagaattaggtctagagta

SEQ ID NO: 10059906 - DNA, 22 bp, Homo sapiens
ggcttgttgaaacacagattgt

SEQ ID NO: 10059907 - DNA, 22 bp, Homo sapiens
gcacacattcggattcttaacc

SEQ ID NO: 10059908 - DNA, 22 bp, Homo sapiens
gcatgcagtaaaattcagcaac

SEQ ID NO: 10059909 - DNA, 22 bp, Homo sapiens
gctacatagtaacccacaaatc

SEQ ID NO: 10059910 - DNA, 22 bp, Homo sapiens
ggagacagtgacttagagactg

SEQ ID NO: 10059911 - DNA, 22 bp, Homo sapiens
ggagcatgtggggtgagcaggg

SEQ ID NO: 10059912 - DNA, 22 bp, Homo sapiens
tatacacatttttacctatagt

SEQ ID NO: 10059913 - DNA, 23 bp, Homo sapiens
tatacacatgtggcagtatagtg

SEQ ID NO: 10059914 - DNA, 22 bp, Homo sapiens
tatacacatcctccaaagatag

SEQ ID NO: 10059915 - DNA, 22 bp, Homo sapiens
tatacacatatcttctaggcct

SEQ ID NO: 10059916 - DNA, 17 bp, Homo sapiens
tatacacagacagactg

SEQ ID NO: 10059917 - DNA, 22 bp, Homo sapiens
tatacacatatacgtttgtgtg

SEQ ID NO: 10059918 - DNA, 22 bp, Homo sapiens
tatacaagtaatgctgaatgat

SEQ ID NO: 10059919 - DNA, 22 bp, Homo sapiens
tatacacaaggtgtgcatttgt

SEQ ID NO: 10059920 - DNA, 22 bp, Homo sapiens
tatgtcctgctactctctcatg

SEQ ID NO: 10059921 - DNA, 22 bp, Homo sapiens
tatgtacagggatagaacttga

SEQ ID NO: 10059922 - DNA, 22 bp, Homo sapiens
tactttttatgataagaactga

SEQ ID NO: 10059923 - DNA, 22 bp, Homo sapiens
tacttttcctggaaccactgct

SEQ ID NO: 10059924 - DNA, 19 bp, Homo sapiens
tagaaagccagaaaacaga

SEQ ID NO: 10059925 - DNA, 22 bp, Homo sapiens
tagaaagcgttaaatctacaga

SEQ ID NO: 10059926 - DNA, 22 bp, Homo sapiens
tagaaagctgagtaatacattt

SEQ ID NO: 10059927 - DNA, 22 bp, Homo sapiens
tagaaagctggaggaattcttt

SEQ ID NO: 10059928 - DNA, 23 bp, Homo sapiens
tacagaaggagtagtcactaaga

SEQ ID NO: 10059929 - DNA, 22 bp, Homo sapiens
tacatagagggtaatagcatca

SEQ ID NO: 10059930 - DNA, 22 bp, Homo sapiens
tacatagattttgaaactggac

SEQ ID NO: 10059931 - DNA, 22 bp, Homo sapiens
tacagtagaatgcggtgccagt

SEQ ID NO: 10059932 - DNA, 22 bp, Homo sapiens
tacagtagctgaggttctcagg

SEQ ID NO: 10059933 - DNA, 22 bp, Homo sapiens
tacagtagctactcaataacta

SEQ ID NO: 10059934 - DNA, 22 bp, Homo sapiens
tacagtagaatcttatagccca

SEQ ID NO: 10059935 - DNA, 22 bp, Homo sapiens
tacatctagccttacaattatt

SEQ ID NO: 10059936 - DNA, 22 bp, Homo sapiens
taaagtgtgcatggtcaaatat

SEQ ID NO: 10059937 - DNA, 22 bp, Homo sapiens
gttttcttcctgcaattggcat

SEQ ID NO: 10059938 - DNA, 22 bp, Homo sapiens
gttgctcaggcaggagtacagt

SEQ ID NO: 10059939 - DNA, 22 bp, Homo sapiens
gttgctctatgtgtgttctatg

SEQ ID NO: 10059940 - DNA, 22 bp, Homo sapiens
tcatataactggatattttcaa

SEQ ID NO: 10059941 - DNA, 22 bp, Homo sapiens
tcatgctagttaagaacacaat

SEQ ID NO: 10059942 - DNA, 18 bp, Homo sapiens
tcattcaaagtctactga

SEQ ID NO: 10059943 - DNA, 19 bp, Homo sapiens
tcacttgtgccaggcactg

SEQ ID NO: 10059944 - DNA, 22 bp, Homo sapiens
tcactgaagtcttcaagtagga

SEQ ID NO: 10059945 - DNA, 22 bp, Homo sapiens
tcaagacagtgtgatactggcc

SEQ ID NO: 10059946 - DNA, 22 bp, Homo sapiens
tcaagacagatgggtaacttgg

SEQ ID NO: 10059947 - DNA, 18 bp, Homo sapiens
tcaagacatcatgaaata

SEQ ID NO: 10059948 - DNA, 22 bp, Homo sapiens
tcaaggactattgcatgactcc

SEQ ID NO: 10059949 - DNA, 22 bp, Homo sapiens
tcacactttccatggctgttaa

SEQ ID NO: 10059950 - DNA, 22 bp, Homo sapiens
tcacagaaaagctgagcatcag

SEQ ID NO: 10059951 - DNA, 22 bp, Homo sapiens
tcacagaaggagggaagctagt

SEQ ID NO: 10059952 - DNA, 22 bp, Homo sapiens
tcacagaagccctcgcaaacta

SEQ ID NO: 10059953 - DNA, 22 bp, Homo sapiens
tccagcattcttagacctctat

SEQ ID NO: 10059954 - DNA, 22 bp, Homo sapiens
tccaggaggttgagactgcagt

SEQ ID NO: 10059955 - DNA, 22 bp, Homo sapiens
tccaggagtttgagactgcagt

SEQ ID NO: 10059956 - DNA, 22 bp, Homo sapiens
tttcaaactttactcttgaatc

SEQ ID NO: 10059957 - DNA, 22 bp, Homo sapiens
tttctaatctttagttacaaaa

SEQ ID NO: 10059958 - DNA, 22 bp, Homo sapiens
tttctaatctgattctcctacc

SEQ ID NO: 10059959 - DNA, 22 bp, Homo sapiens
tttcttcacagggtattgggtg

SEQ ID NO: 10059960 - DNA, 22 bp, Homo sapiens
tttcttcatagaccttgtcttg

SEQ ID NO: 10059961 - DNA, 22 bp, Homo sapiens
tttcaaacattcctgggagact

SEQ ID NO: 10059962 - DNA, 22 bp, Homo sapiens
tttcaaaccactgaggttctga

SEQ ID NO: 10059963 - DNA, 22 bp, Homo sapiens
tttcaaactatgtgtcaggcag

SEQ ID NO: 10059964 - DNA, 22 bp, Homo sapiens
tttcaaacctacttgtatgttt

SEQ ID NO: 10059965 - DNA, 20 bp, Homo sapiens
tttcaaactgcacctttgct

SEQ ID NO: 10059966 - DNA, 22 bp, Homo sapiens
tttcaaactccagctcaccaat

SEQ ID NO: 10059967 - DNA, 22 bp, Homo sapiens
tttcaaactgggagtgagggga

SEQ ID NO: 10059968 - DNA, 22 bp, Homo sapiens
tttcaaactgcccagcacacct

SEQ ID NO: 10059969 - DNA, 22 bp, Homo sapiens
tttcaaacttaaatacctttcc

SEQ ID NO: 10059970 - DNA, 22 bp, Homo sapiens
tttcaaactgtactttccccta

SEQ ID NO: 10059971 - DNA, 22 bp, Homo sapiens
tttcaaacatatcttcattact

SEQ ID NO: 10059972 - DNA, 22 bp, Homo sapiens
tttcaaacatagatctgaatat

SEQ ID NO: 10059973 - DNA, 22 bp, Homo sapiens
ttgtttccattgcagactgtgt

SEQ ID NO: 10059974 - DNA, 22 bp, Homo sapiens
ttgtttccataattaagtgtga

SEQ ID NO: 10059975 - DNA, 22 bp, Homo sapiens
ttgtttccagcaaatagtccat

SEQ ID NO: 10059976 - DNA, 21 bp, Homo sapiens
ttgtttcccagagctcgctcc

SEQ ID NO: 10059977 - DNA, 21 bp, Homo sapiens
ttgtttcctcccaaaatgcca

SEQ ID NO: 10059978 - DNA, 22 bp, Homo sapiens
ttgtttccctggatctagagct

SEQ ID NO: 10059979 - DNA, 22 bp, Homo sapiens
ttgtttcctttctatacaggat

SEQ ID NO: 10059980 - DNA, 23 bp, Homo sapiens
ttgtccttctgaaatatatctgg

SEQ ID NO: 10059981 - DNA, 22 bp, Homo sapiens
tttggagagagttaaatatgtt

SEQ ID NO: 10059982 - DNA, 22 bp, Homo sapiens
tttgtacatgtaagattgcatc

SEQ ID NO: 10059983 - DNA, 22 bp, Homo sapiens
ttttcctttcatcaggacaaag

SEQ ID NO: 10059984 - DNA, 23 bp, Homo sapiens
ttttgacaggaggaaggtgttga

SEQ ID NO: 10059985 - DNA, 23 bp, Homo sapiens
ttctttcaagaagttcacagtgc

SEQ ID NO: 10059986 - DNA, 22 bp, Homo sapiens
ttctttcaatagctggcatatg

SEQ ID NO: 10059987 - DNA, 22 bp, Homo sapiens
ttctgcttttagctaaactata

SEQ ID NO: 10059988 - DNA, 22 bp, Homo sapiens
ttctgagagtaaacatagcctg

SEQ ID NO: 10059989 - DNA, 22 bp, Homo sapiens
ttctgagagtgccagaagttct

SEQ ID NO: 10059990 - DNA, 22 bp, Homo sapiens
ttctgagatgtgaatctgtcaa

SEQ ID NO: 10059991 - DNA, 20 bp, Homo sapiens
ttctgagattaggttacaaa

SEQ ID NO: 10059992 - DNA, 22 bp, Homo sapiens
ttctgagaaatgggttcacata

SEQ ID NO: 10059993 - DNA, 22 bp, Homo sapiens
ttctgacatatccagtctcagt

SEQ ID NO: 10059994 - DNA, 22 bp, Homo sapiens
ttctgacacattactacatgga

SEQ ID NO: 10059995 - DNA, 22 bp, Homo sapiens
ttctgacaattcagtaacagca

SEQ ID NO: 10059996 - DNA, 22 bp, Homo sapiens
ttctgtttattcctaggagctc

SEQ ID NO: 10059997 - DNA, 22 bp, Homo sapiens
ttccttacattcatatggcttc

SEQ ID NO: 10059998 - DNA, 22 bp, Homo sapiens
ttctaagagagtacaagcaatt

SEQ ID NO: 10059999 - DNA, 22 bp, Homo sapiens
ttctaagtctgctgtcttcatc

SEQ ID NO: 10060000 - DNA, 22 bp, Homo sapiens
ttctaatgaaatctgtacagta

SEQ ID NO: 10060001 - DNA, 22 bp, Homo sapiens
ttctaatgaaagtggaccatgg

SEQ ID NO: 10060002 - DNA, 22 bp, Homo sapiens
ttctaatctgggcttctgcagt

SEQ ID NO: 10060003 - DNA, 22 bp, Homo sapiens
ttcaacatgctttatttctaaa

SEQ ID NO: 10060004 - DNA, 22 bp, Homo sapiens
ttcaagaaagagtggctattcc

SEQ ID NO: 10060005 - DNA, 22 bp, Homo sapiens
ttacacttgtaattatataacg

SEQ ID NO: 10060006 - DNA, 22 bp, Homo sapiens
ttacacatgaaggtccaatgtt

SEQ ID NO: 10060007 - DNA, 22 bp, Homo sapiens
ttaactctccctccttacatcc

SEQ ID NO: 10060008 - DNA, 22 bp, Homo sapiens
ttaacatttgtgaagcatttag

SEQ ID NO: 10060009 - DNA, 22 bp, Homo sapiens
tgttttctgattctcgtgtggt

SEQ ID NO: 10060010 - DNA, 22 bp, Homo sapiens
tgttctcagtaattctatttta

SEQ ID NO: 10060011 - DNA, 22 bp, Homo sapiens
tgtttcctttctggtgagcata

SEQ ID NO: 10060012 - DNA, 22 bp, Homo sapiens
tgtttacatgcataagcttaag

SEQ ID NO: 10060013 - DNA, 22 bp, Homo sapiens
tgttcaaaaatatcttctgcaa

SEQ ID NO: 10060014 - DNA, 21 bp, Homo sapiens
tgttcaaacgtacacatttct

SEQ ID NO: 10060015 - DNA, 22 bp, Homo sapiens
tgttcaagtggatgtggctttt

SEQ ID NO: 10060016 - DNA, 22 bp, Homo sapiens
tgttcaaatcttttgcttattt

SEQ ID NO: 10060017 - DNA, 22 bp, Homo sapiens
tgttcagaacaaaggtaaatga

SEQ ID NO: 10060018 - DNA, 22 bp, Homo sapiens
tgtgtaacaatctacacttagg

SEQ ID NO: 10060019 - DNA, 22 bp, Homo sapiens
ctgcaagctggtaataagcaga

SEQ ID NO: 10060020 - DNA, 22 bp, Homo sapiens
ctgcaagccagggagagatgcc

SEQ ID NO: 10060021 - DNA, 22 bp, Homo sapiens
ctgcaagccaagctgagagcct

SEQ ID NO: 10060022 - DNA, 22 bp, Homo sapiens
ctgcatccatgttgctgcaaag

SEQ ID NO: 10060023 - DNA, 22 bp, Homo sapiens
ctgcagagacctaggtcaggtt

SEQ ID NO: 10060024 - DNA, 22 bp, Homo sapiens
ctgcagagaattgtggggcttc

SEQ ID NO: 10060025 - DNA, 22 bp, Homo sapiens
ctgcagagatgaagaaggtggc

SEQ ID NO: 10060026 - DNA, 19 bp, Homo sapiens
ctgtggcctccaggaggga

SEQ ID NO: 10060027 - DNA, 22 bp, Homo sapiens
ctcctggctctgccacttacta

SEQ ID NO: 10060028 - DNA, 22 bp, Homo sapiens
ctccctctcaccggagccctgg

SEQ ID NO: 10060029 - DNA, 22 bp, Homo sapiens
ctccagctgagtaagaacacta

SEQ ID NO: 10060030 - DNA, 22 bp, Homo sapiens
cctgcagagggagggccttatt

SEQ ID NO: 10060031 - DNA, 22 bp, Homo sapiens
cctgcagagggactggcaggaa

SEQ ID NO: 10060032 - DNA, 22 bp, Homo sapiens
cctgcagagccacgtgccagcg

SEQ ID NO: 10060033 - DNA, 22 bp, Homo sapiens
cctgcagagcaggagaggcatc

SEQ ID NO: 10060034 - DNA, 22 bp, Homo sapiens
cctgcagaccacactcagtcct

SEQ ID NO: 10060035 - DNA, 22 bp, Homo sapiens
cctgcagaggtcaggccagaaa

SEQ ID NO: 10060036 - DNA, 22 bp, Homo sapiens
cctgcagagtccctttgttcag

SEQ ID NO: 10060037 - DNA, 22 bp, Homo sapiens
cctgcagatgtgggacagctgt

SEQ ID NO: 10060038 - DNA, 22 bp, Homo sapiens
cctgtgagtcaacccctccttg

SEQ ID NO: 10060039 - DNA, 22 bp, Homo sapiens
cctgtgcagcccttgccagttt

SEQ ID NO: 10060040 - DNA, 22 bp, Homo sapiens
cctgtgcatccggtggtcattg

SEQ ID NO: 10060041 - DNA, 17 bp, Homo sapiens
cgggcatggagggcagg

SEQ ID NO: 10060042 - DNA, 19 bp, Homo sapiens
ccctggcaggcaagcctgg

SEQ ID NO: 10060043 - DNA, 22 bp, Homo sapiens
ccctggcagagggggcaggtgc

SEQ ID NO: 10060044 - DNA, 22 bp, Homo sapiens
ccctggcataaaacttctccag

SEQ ID NO: 10060045 - DNA, 22 bp, Homo sapiens
ccctggcaaaatccctggtaca

SEQ ID NO: 10060046 - DNA, 22 bp, Homo sapiens
ccctggcaagtgctgtgtagct

SEQ ID NO: 10060047 - DNA, 22 bp, Homo sapiens
ccctggcacatgcgctgtgtgg

SEQ ID NO: 10060048 - DNA, 22 bp, Homo sapiens
ccctgaggatagggcaggaccc

SEQ ID NO: 10060049 - DNA, 22 bp, Homo sapiens
aggcctgggcaagaaggggcgt

SEQ ID NO: 10060050 - DNA, 22 bp, Homo sapiens
aggcctgggtctcgtgcctacc

SEQ ID NO: 10060051 - DNA, 22 bp, Homo sapiens
aggcctgggacgggagccgtga

SEQ ID NO: 10060052 - DNA, 22 bp, Homo sapiens
aggctgccatagggaactgcat

SEQ ID NO: 10060053 - DNA, 22 bp, Homo sapiens
cccacgtcgaacttgctccaga

SEQ ID NO: 10060054 - DNA, 22 bp, Homo sapiens
agctgtctgtgaacacagcatt

SEQ ID NO: 10060055 - DNA, 22 bp, Homo sapiens
caggagccagctgtcccaacca

SEQ ID NO: 10060056 - DNA, 22 bp, Homo sapiens
caggcacaatgagcgccatctt

SEQ ID NO: 10060057 - DNA, 22 bp, Homo sapiens
aggaagtgcagggggaagtact

SEQ ID NO: 10060058 - DNA, 22 bp, Homo sapiens
aggaagtgactaggtaacccaa

SEQ ID NO: 10060059 - DNA, 22 bp, Homo sapiens
aggaagtgggaagggtctgcca

SEQ ID NO: 10060060 - DNA, 21 bp, Homo sapiens
aggaagtggccagattgggaa

SEQ ID NO: 10060061 - DNA, 22 bp, Homo sapiens
aggaagtggggttctctcactg

SEQ ID NO: 10060062 - DNA, 22 bp, Homo sapiens
aggaagtgtcagggataacgat

SEQ ID NO: 10060063 - DNA, 22 bp, Homo sapiens
catgagggttggggtggagctt

SEQ ID NO: 10060064 - DNA, 22 bp, Homo sapiens
ccacccagaccagggatctggg

SEQ ID NO: 10060065 - DNA, 22 bp, Homo sapiens
ggccacgtgacctctggctcct

SEQ ID NO: 10060066 - DNA, 23 bp, Homo sapiens
ggccactgaattttctgcatctt

SEQ ID NO: 10060067 - DNA, 22 bp, Homo sapiens
ggcctgggcctttgtgttttga

SEQ ID NO: 10060068 - DNA, 22 bp, Homo sapiens
ggcctgggctccgggagttact

SEQ ID NO: 10060069 - DNA, 22 bp, Homo sapiens
cacagaggaatgcatcagcaga

SEQ ID NO: 10060070 - DNA, 22 bp, Homo sapiens
cacagaggagtgcacactctct

SEQ ID NO: 10060071 - DNA, 22 bp, Homo sapiens
cacagaggcatgaccctgccct

SEQ ID NO: 10060072 - DNA, 22 bp, Homo sapiens
ggagctgctcagagccagtccc

SEQ ID NO: 10060073 - DNA, 22 bp, Homo sapiens
ggagctgctttgatctgaagaa

SEQ ID NO: 10060074 - DNA, 23 bp, Homo sapiens
ggagctgctgttgggggagctgc

SEQ ID NO: 10060075 - DNA, 22 bp, Homo sapiens
cacagaggtctgggcccagcag

SEQ ID NO: 10060076 - DNA, 22 bp, Homo sapiens
ggtgactggagggacccaggcc

SEQ ID NO: 10060077 - DNA, 22 bp, Homo sapiens
gggccacggaaggaccagtggg

SEQ ID NO: 10060078 - DNA, 22 bp, Homo sapiens
gggctgaccccacccctcactc

SEQ ID NO: 10060079 - DNA, 22 bp, Homo sapiens
gggctgacaccacccaggcgca

SEQ ID NO: 10060080 - DNA, 22 bp, Homo sapiens
cagagctggctctgcatgtaca

SEQ ID NO: 10060081 - DNA, 22 bp, Homo sapiens
cagcccaggccgacagttcctc

SEQ ID NO: 10060082 - DNA, 22 bp, Homo sapiens
cagcctgactatggctgcaggt

SEQ ID NO: 10060083 - DNA, 19 bp, Homo sapiens
gccaggtcttgggtccagg

SEQ ID NO: 10060084 - DNA, 22 bp, Homo sapiens
gccaggtctgggtagcagagga

SEQ ID NO: 10060085 - DNA, 22 bp, Homo sapiens
gcctggcacattgcagtggatt

SEQ ID NO: 10060086 - DNA, 21 bp, Homo sapiens
gcctggcaaaaaccggccctg

SEQ ID NO: 10060087 - DNA, 23 bp, Homo sapiens
gcctggcaaagcactaccgagag

SEQ ID NO: 10060088 - DNA, 22 bp, Homo sapiens
gcctggcacaggaattaggagg

SEQ ID NO: 10060089 - DNA, 22 bp, Homo sapiens
gcctggcaatggcctcaggaag

SEQ ID NO: 10060090 - DNA, 22 bp, Homo sapiens
gcagctgctggagggaggcagg

SEQ ID NO: 10060091 - DNA, 22 bp, Homo sapiens
gcagcagagtagacagagccct

SEQ ID NO: 10060092 - DNA, 22 bp, Homo sapiens
gactggagcccccaaggacacc

SEQ ID NO: 10060093 - DNA, 20 bp, Homo sapiens
cagagctgttatggatgatg

SEQ ID NO: 10060094 - DNA, 22 bp, Homo sapiens
agccaactccagcccctgcagc

SEQ ID NO: 10060095 - DNA, 22 bp, Homo sapiens
cagcccagaactcacgtctcca

SEQ ID NO: 10060096 - DNA, 22 bp, Homo sapiens
cagcccagagaaggggcccgtg

SEQ ID NO: 10060097 - DNA, 22 bp, Homo sapiens
cagcccaggtctctcttccagt

SEQ ID NO: 10060098 - DNA, 22 bp, Homo sapiens
cagccctgggtccctgccctgg

SEQ ID NO: 10060099 - DNA, 22 bp, Homo sapiens
cagcccatggtttgtggccagt

SEQ ID NO: 10060100 - DNA, 22 bp, Homo sapiens
cagcccatttctgggacctgag

SEQ ID NO: 10060101 - DNA, 22 bp, Homo sapiens
agcgccactgcactccagcctg

SEQ ID NO: 10060102 - DNA, 22 bp, Homo sapiens
cagctgccagcttctctccatc

SEQ ID NO: 10060103 - DNA, 22 bp, Homo sapiens
cagctgccatgacatgtcctgc

SEQ ID NO: 10060104 - DNA, 20 bp, Homo sapiens
cactgggctggagtcagggc

SEQ ID NO: 10060105 - DNA, 23 bp, Homo sapiens
cactgggggctgctacagagagg

SEQ ID NO: 10060106 - DNA, 22 bp, Homo sapiens
caagctgggtgcgggcagtata

SEQ ID NO: 10060107 - DNA, 22 bp, Homo sapiens
atgtcttctgtggagacaggta

SEQ ID NO: 10060108 - DNA, 22 bp, Homo sapiens
agaggccggccgagcccatggg

SEQ ID NO: 10060109 - DNA, 22 bp, Homo sapiens
aggggccatgtaagtgtatcac

SEQ ID NO: 10060110 - DNA, 22 bp, Homo sapiens
aggggccacctgtggcaccctg

SEQ ID NO: 10060111 - DNA, 21 bp, Homo sapiens
aggtgcaggcctcaagcccca

SEQ ID NO: 10060112 - DNA, 22 bp, Homo sapiens
aggtgtcatttctctgcaggtg

SEQ ID NO: 10060113 - DNA, 22 bp, Homo sapiens
actggggcaggaaagtatgctg

SEQ ID NO: 10060114 - DNA, 22 bp, Homo sapiens
actggggcagtgggcagtggtt

SEQ ID NO: 10060115 - DNA, 22 bp, Homo sapiens
atcctggctttaggtcagaggc

SEQ ID NO: 10060116 - DNA, 22 bp, Homo sapiens
atcctggcccaggtgtggaggg

SEQ ID NO: 10060117 - DNA, 22 bp, Homo sapiens
aagaagcagctgccaggccagt

SEQ ID NO: 10060118 - DNA, 22 bp, Homo sapiens
acagaggcctcggcctgcccag

SEQ ID NO: 10060119 - DNA, 22 bp, Homo sapiens
agcggcgccgagcttggccagg

SEQ ID NO: 10060120 - DNA, 18 bp, Homo sapiens
agctgaggggactgaaga

SEQ ID NO: 10060121 - DNA, 22 bp, Homo sapiens
acaccagggatatgaggaagga

SEQ ID NO: 10060122 - DNA, 22 bp, Homo sapiens
agagctgccctgccagttctaa

SEQ ID NO: 10060123 - DNA, 22 bp, Homo sapiens
agagctgccgagctggggccat

SEQ ID NO: 10060124 - DNA, 22 bp, Homo sapiens
agagctgcacctatgcagacct

SEQ ID NO: 10060125 - DNA, 22 bp, Homo sapiens
agagctgcaatttcatgtggtg

SEQ ID NO: 10060126 - DNA, 22 bp, Homo sapiens
tcccaagcaatgagtcagggcc

SEQ ID NO: 10060127 - DNA, 22 bp, Homo sapiens
tcactctgttttactcactgtt

SEQ ID NO: 10060128 - DNA, 17 bp, Homo sapiens
tcagaccctgtgtcagg

SEQ ID NO: 10060129 - DNA, 20 bp, Homo sapiens
tcagacccggggaagggagc

SEQ ID NO: 10060130 - DNA, 22 bp, Homo sapiens
tcagcctgctccaagtgctgcc

SEQ ID NO: 10060131 - DNA, 22 bp, Homo sapiens
tcagcctgcgtcatggtgacac

SEQ ID NO: 10060132 - DNA, 22 bp, Homo sapiens
gctggagacctcagagaaccca

SEQ ID NO: 10060133 - DNA, 22 bp, Homo sapiens
gctccctgcatttcccaccctt

SEQ ID NO: 10060134 - DNA, 17 bp, Homo sapiens
gctccctgaggacagct

SEQ ID NO: 10060135 - DNA, 22 bp, Homo sapiens
gctccctggtattgctgccact

SEQ ID NO: 10060136 - DNA, 22 bp, Homo sapiens
gctccctggtagccatgctctc

SEQ ID NO: 10060137 - DNA, 22 bp, Homo sapiens
gctccctgctccttcaccgacc

SEQ ID NO: 10060138 - DNA, 22 bp, Homo sapiens
gcgggtggaacggctccacgtg

SEQ ID NO: 10060139 - DNA, 23 bp, Homo sapiens
gccagccttgctctcctgcagcc

SEQ ID NO: 10060140 - DNA, 22 bp, Homo sapiens
gccagcctgtgggggctctgtg

SEQ ID NO: 10060141 - DNA, 22 bp, Homo sapiens
gccccagctctgccacaactag

SEQ ID NO: 10060142 - DNA, 22 bp, Homo sapiens
gcccagctggcttccagcacat

SEQ ID NO: 10060143 - DNA, 22 bp, Homo sapiens
gcccagctgtctggcagggatg

SEQ ID NO: 10060144 - DNA, 22 bp, Homo sapiens
gccccaagggagcccagcacac

SEQ ID NO: 10060145 - DNA, 22 bp, Homo sapiens
gccaggtcacctcactcatcca

SEQ ID NO: 10060146 - DNA, 22 bp, Homo sapiens
gcagagaaagttttgtcctcag

SEQ ID NO: 10060147 - DNA, 21 bp, Homo sapiens
gcagaggcacggcaccaaggg

SEQ ID NO: 10060148 - DNA, 22 bp, Homo sapiens
gcaggaagaggctcgaagcccc

SEQ ID NO: 10060149 - DNA, 22 bp, Homo sapiens
gcaggaagatgagctcaggtaa

SEQ ID NO: 10060150 - DNA, 22 bp, Homo sapiens
gcaggaagccttaccaagccca

SEQ ID NO: 10060151 - DNA, 20 bp, Homo sapiens
gcagcctcaacaggcacagc

SEQ ID NO: 10060152 - DNA, 22 bp, Homo sapiens
gggcaagcacagcgagcgtgcg

SEQ ID NO: 10060153 - DNA, 22 bp, Homo sapiens
ggctccagaaatcatagagcag

SEQ ID NO: 10060154 - DNA, 22 bp, Homo sapiens
ggccatgagaatgtgcaggtcc

SEQ ID NO: 10060155 - DNA, 22 bp, Homo sapiens
ggccatgagcagccctgtggga

SEQ ID NO: 10060156 - DNA, 22 bp, Homo sapiens
ggtcacgtgaccgcacctgcct

SEQ ID NO: 10060157 - DNA, 22 bp, Homo sapiens
gggctgcatcagcaggacccgg

SEQ ID NO: 10060158 - DNA, 22 bp, Homo sapiens
ggggccgaccgcggttcaggcc

SEQ ID NO: 10060159 - DNA, 22 bp, Homo sapiens
gtcctgggaaggaagccaggga

SEQ ID NO: 10060160 - DNA, 17 bp, Homo sapiens
gtcctgggaggagagag

SEQ ID NO: 10060161 - DNA, 20 bp, Homo sapiens
gtgcaggttccccttgcact

SEQ ID NO: 10060162 - DNA, 22 bp, Homo sapiens
gtgcagaggtcacaaaagtgaa

SEQ ID NO: 10060163 - DNA, 22 bp, Homo sapiens
gtctgccctggggcatcagttt

SEQ ID NO: 10060164 - DNA, 20 bp, Homo sapiens
gtctgcccaggccaccacgg

SEQ ID NO: 10060165 - DNA, 22 bp, Homo sapiens
ctggcagcttcaggacactcgg

SEQ ID NO: 10060166 - DNA, 22 bp, Homo sapiens
ctggcagcccaacctagagtct

SEQ ID NO: 10060167 - DNA, 22 bp, Homo sapiens
ctggcaggaaggcatttagaca

SEQ ID NO: 10060168 - DNA, 22 bp, Homo sapiens
ctggcagcttcctttgcatctg

SEQ ID NO: 10060169 - DNA, 20 bp, Homo sapiens
ctggcaggagcgagtctacc

SEQ ID NO: 10060170 - DNA, 22 bp, Homo sapiens
ctggcaggagcattcacagagg

SEQ ID NO: 10060171 - DNA, 22 bp, Homo sapiens
ctggcaggcagacttctgcaag

SEQ ID NO: 10060172 - DNA, 22 bp, Homo sapiens
ctggcaggcggcagagcccagg

SEQ ID NO: 10060173 - DNA, 22 bp, Homo sapiens
ctgggctgctgtccactagggt

SEQ ID NO: 10060174 - DNA, 22 bp, Homo sapiens
ctgggctgcagcgggagcgacg

SEQ ID NO: 10060175 - DNA, 22 bp, Homo sapiens
ctggggctgcggtggaggagcc

SEQ ID NO: 10060176 - DNA, 22 bp, Homo sapiens
ctggggctgcggacgggagccc

SEQ ID NO: 10060177 - DNA, 22 bp, Homo sapiens
ctggggccagtgaggaggcttt

SEQ ID NO: 10060178 - DNA, 22 bp, Homo sapiens
ctggggcccgagccttgggcca

SEQ ID NO: 10060179 - DNA, 22 bp, Homo sapiens
ctggggctcactccagccctgg

SEQ ID NO: 10060180 - DNA, 22 bp, Homo sapiens
ctgggcagttttacatcattgc

SEQ ID NO: 10060181 - DNA, 22 bp, Homo sapiens
ctgggcagtttattcagttctg

SEQ ID NO: 10060182 - DNA, 22 bp, Homo sapiens
cttgccaggatcagagtcacag

SEQ ID NO: 10060183 - DNA, 22 bp, Homo sapiens
cttgcagcatccggtcctctct

SEQ ID NO: 10060184 - DNA, 22 bp, Homo sapiens
cttcctggccattgccatggca

SEQ ID NO: 10060185 - DNA, 22 bp, Homo sapiens
cttcctgggtcagcctggaggt

SEQ ID NO: 10060186 - DNA, 22 bp, Homo sapiens
ctgggtgctgtgggctcagagg

SEQ ID NO: 10060187 - DNA, 22 bp, Homo sapiens
ctgtgcagtggggctctgggtt

SEQ ID NO: 10060188 - DNA, 22 bp, Homo sapiens
gaagcccaagcttcacagctat

SEQ ID NO: 10060189 - DNA, 22 bp, Homo sapiens
gaagcccagggcgtggccgggc

SEQ ID NO: 10060190 - DNA, 22 bp, Homo sapiens
gacccagggtttctgcacaggg

SEQ ID NO: 10060191 - DNA, 22 bp, Homo sapiens
gagaaggagtagctgacctggg

SEQ ID NO: 10060192 - DNA, 22 bp, Homo sapiens
cggtcaggtgcagcgttggcac

SEQ ID NO: 10060193 - DNA, 22 bp, Homo sapiens
cctgggctggagtacagcagtg

SEQ ID NO: 10060194 - DNA, 22 bp, Homo sapiens
cctgggcaaattatgttactca

SEQ ID NO: 10060195 - DNA, 22 bp, Homo sapiens
cctgggcaaatgccagagacaa

SEQ ID NO: 10060196 - DNA, 22 bp, Homo sapiens
cctgtcagccccacttctgcct

SEQ ID NO: 10060197 - DNA, 22 bp, Homo sapiens
ctctcctggtgtggaggacagg

SEQ ID NO: 10060198 - DNA, 22 bp, Homo sapiens
ctcctggccacgttcttgctgg

SEQ ID NO: 10060199 - DNA, 17 bp, Homo sapiens
ctcctggcagcctcagg

SEQ ID NO: 10060200 - DNA, 22 bp, Homo sapiens
ctgacagcgagagagttgcccc

SEQ ID NO: 10060201 - DNA, 22 bp, Homo sapiens
ctgacagctgaattgcttgcat

SEQ ID NO: 10060202 - DNA, 22 bp, Homo sapiens
ctgcagggatgtgaggcccgtt

SEQ ID NO: 10060203 - DNA, 22 bp, Homo sapiens
tgggctgctgtctgcacatgct

SEQ ID NO: 10060204 - DNA, 22 bp, Homo sapiens
tgggctgctgagaatgagagag

SEQ ID NO: 10060205 - DNA, 22 bp, Homo sapiens
cctagcagggaagcagtgagga

SEQ ID NO: 10060206 - DNA, 22 bp, Homo sapiens
tggcaggtagagttctgagatg

SEQ ID NO: 10060207 - DNA, 22 bp, Homo sapiens
ccctgcagccttgcatgccttc

SEQ ID NO: 10060208 - DNA, 23 bp, Homo sapiens
cccaggtcaaaattcacaggcct

SEQ ID NO: 10060209 - DNA, 22 bp, Homo sapiens
cccaggtcccggggccagctgc

SEQ ID NO: 10060210 - DNA, 22 bp, Homo sapiens
cccaggtcccgccccagctcta

SEQ ID NO: 10060211 - DNA, 22 bp, Homo sapiens
cccaggtcgtcagcagtgtggt

SEQ ID NO: 10060212 - DNA, 22 bp, Homo sapiens
ccagctctctgcagaaaggact

SEQ ID NO: 10060213 - DNA, 22 bp, Homo sapiens
ccagctgctgtgaggaccacag

SEQ ID NO: 10060214 - DNA, 22 bp, Homo sapiens
ccagctgcccaagaggcatcct

SEQ ID NO: 10060215 - DNA, 22 bp, Homo sapiens
tctggcaggggttctgcacttg

SEQ ID NO: 10060216 - DNA, 22 bp, Homo sapiens
tctggcaggccttgtcaatctg

SEQ ID NO: 10060217 - DNA, 21 bp, Homo sapiens
tctggcaggcacgggcccagc

SEQ ID NO: 10060218 - DNA, 22 bp, Homo sapiens
tctggcaggacatgctgaccat

SEQ ID NO: 10060219 - DNA, 22 bp, Homo sapiens
tctggcaggaccatgaagcgta

SEQ ID NO: 10060220 - DNA, 22 bp, Homo sapiens
tctggcagctatcctctggcca

SEQ ID NO: 10060221 - DNA, 22 bp, Homo sapiens
tctggcagctctcctcggcgga

SEQ ID NO: 10060222 - DNA, 22 bp, Homo sapiens
tctgggagcagatgatggtata

SEQ ID NO: 10060223 - DNA, 22 bp, Homo sapiens
tctgggagcacacgcagtgatc

SEQ ID NO: 10060224 - DNA, 22 bp, Homo sapiens
tctgggagatccaagcagaact

SEQ ID NO: 10060225 - DNA, 22 bp, Homo sapiens
tctgggagagtcacaggcattg

SEQ ID NO: 10060226 - DNA, 22 bp, Homo sapiens
tctgggagcctgaaagtgaatg

SEQ ID NO: 10060227 - DNA, 22 bp, Homo sapiens
tctgggagcagctcagcagatt

SEQ ID NO: 10060228 - DNA, 22 bp, Homo sapiens
tgagaagggttggagaaataat

SEQ ID NO: 10060229 - DNA, 19 bp, Homo sapiens
ccatgcagcctgggggcag

SEQ ID NO: 10060230 - DNA, 23 bp, Homo sapiens
cagctcagagtgtgtcctgtttc

SEQ ID NO: 10060231 - DNA, 22 bp, Homo sapiens
caggcccacgaggcacacagag

SEQ ID NO: 10060232 - DNA, 22 bp, Homo sapiens
caggcctgaccctgagcttcac

SEQ ID NO: 10060233 - DNA, 22 bp, Homo sapiens
caggtgcccaggggacagtggc

SEQ ID NO: 10060234 - DNA, 22 bp, Homo sapiens
taggcatgcaaataaatgtgca

SEQ ID NO: 10060235 - DNA, 22 bp, Homo sapiens
cagggccatatcttgtgcacca

SEQ ID NO: 10060236 - DNA, 22 bp, Homo sapiens
caggggcctgtcctggcttctg

SEQ ID NO: 10060237 - DNA, 22 bp, Homo sapiens
cagggtcatggcacctgcacgg

SEQ ID NO: 10060238 - DNA, 22 bp, Homo sapiens
cagggtcaagagactccagcag

SEQ ID NO: 10060239 - DNA, 21 bp, Homo sapiens
tcctggcaggcccaggaccct

SEQ ID NO: 10060240 - DNA, 22 bp, Homo sapiens
tcctggcagcccgcaggtgctg

SEQ ID NO: 10060241 - DNA, 22 bp, Homo sapiens
tcctggcaggtctgagaggtct

SEQ ID NO: 10060242 - DNA, 22 bp, Homo sapiens
tcctggcaggtgtattggctgt

SEQ ID NO: 10060243 - DNA, 22 bp, Homo sapiens
tcctggcagtaatttgatgttg

SEQ ID NO: 10060244 - DNA, 22 bp, Homo sapiens
tcctggcaggtcagcaggagca

SEQ ID NO: 10060245 - DNA, 22 bp, Homo sapiens
tcctggcagggtggcagcgggt

SEQ ID NO: 10060246 - DNA, 22 bp, Homo sapiens
tcctgggctgtgtgccactctg

SEQ ID NO: 10060247 - DNA, 22 bp, Homo sapiens
tcctggcacccttgggttggag

SEQ ID NO: 10060248 - DNA, 22 bp, Homo sapiens
tcctggcagagagcatgaggcc

SEQ ID NO: 10060249 - DNA, 22 bp, Homo sapiens
tcctggcagaaatggggctgtg

SEQ ID NO: 10060250 - DNA, 22 bp, Homo sapiens
tcctgggcttgctcctccagct

SEQ ID NO: 10060251 - DNA, 22 bp, Homo sapiens
tcctgggcttcacagactctgt

SEQ ID NO: 10060252 - DNA, 22 bp, Homo sapiens
ccactgggggctgctcccaggt

SEQ ID NO: 10060253 - DNA, 22 bp, Homo sapiens
ccactgtgcccagcctcatggg

SEQ ID NO: 10060254 - DNA, 22 bp, Homo sapiens
tccctctacagggaagcgcttt

SEQ ID NO: 10060255 - DNA, 23 bp, Homo sapiens
catggcagcaagagctcatggcc

SEQ ID NO: 10060256 - DNA, 22 bp, Homo sapiens
tgtggccagccacaggcatggt

SEQ ID NO: 10060257 - DNA, 22 bp, Homo sapiens
ttcctagggcagagccgctggg

SEQ ID NO: 10060258 - DNA, 22 bp, Homo sapiens
ctgggcagtttacattcctacc

SEQ ID NO: 10060259 - DNA, 22 bp, Homo sapiens
ctggggaggcagggctgcccct

SEQ ID NO: 10060260 - DNA, 22 bp, Homo sapiens
ctggtggcatcttgagatggtt

SEQ ID NO: 10060261 - DNA, 22 bp, Homo sapiens
ctccagttggccccagttggtt

SEQ ID NO: 10060262 - DNA, 22 bp, Homo sapiens
agtgaccgaggcacttggcaac

SEQ ID NO: 10060263 - DNA, 20 bp, Homo sapiens
agtctgcagctgcatgaccc

SEQ ID NO: 10060264 - DNA, 22 bp, Homo sapiens
cgcctgggagtccacacctgct

SEQ ID NO: 10060265 - DNA, 22 bp, Homo sapiens
cctgggcagcctgctcaaggac

SEQ ID NO: 10060266 - DNA, 22 bp, Homo sapiens
cctgggcagggagaccaggctc

SEQ ID NO: 10060267 - DNA, 22 bp, Homo sapiens
cctgggcagggctggactctca

SEQ ID NO: 10060268 - DNA, 22 bp, Homo sapiens
agggccctctggcaggccaggc

SEQ ID NO: 10060269 - DNA, 22 bp, Homo sapiens
ccaggacaagtgtggccatggc

SEQ ID NO: 10060270 - DNA, 22 bp, Homo sapiens
ccagcctcatcatattcctgct

SEQ ID NO: 10060271 - DNA, 22 bp, Homo sapiens
agctgccacagagcctggccag

SEQ ID NO: 10060272 - DNA, 22 bp, Homo sapiens
agctgcagtgaactgttttgtc

SEQ ID NO: 10060273 - DNA, 22 bp, Homo sapiens
agctgcagtcaagctgggccac

SEQ ID NO: 10060274 - DNA, 20 bp, Homo sapiens
agctgcagaacccactggac

SEQ ID NO: 10060275 - DNA, 18 bp, Homo sapiens
agctgcagaccaggaggt

SEQ ID NO: 10060276 - DNA, 22 bp, Homo sapiens
agctgcagagaaaagaggctgg

SEQ ID NO: 10060277 - DNA, 22 bp, Homo sapiens
agctgcagcactccagtagccg

SEQ ID NO: 10060278 - DNA, 22 bp, Homo sapiens
agctgcagatcaataggctcac

SEQ ID NO: 10060279 - DNA, 23 bp, Homo sapiens
agctgcagatgctcagcgggcag

SEQ ID NO: 10060280 - DNA, 20 bp, Homo sapiens
cagctctgggcaggtcgagg

SEQ ID NO: 10060281 - DNA, 22 bp, Homo sapiens
agctgccacatggtgtcactgt

SEQ ID NO: 10060282 - DNA, 22 bp, Homo sapiens
caggagcccagagtcctcagct

SEQ ID NO: 10060283 - DNA, 22 bp, Homo sapiens
caggtgcagctggatggaagcc

SEQ ID NO: 10060284 - DNA, 22 bp, Homo sapiens
ccaagcatttctagccagtcac

SEQ ID NO: 10060285 - DNA, 22 bp, Homo sapiens
ccaagcatggggttcagtagga

SEQ ID NO: 10060286 - DNA, 22 bp, Homo sapiens
cacgcctgtaatcccagcactt

SEQ ID NO: 10060287 - DNA, 22 bp, Homo sapiens
cacgctggtcattgtagtccag

SEQ ID NO: 10060288 - DNA, 22 bp, Homo sapiens
cacctggctgtgaagcctgggt

SEQ ID NO: 10060289 - DNA, 22 bp, Homo sapiens
caccctggctggaggtgcagtg

SEQ ID NO: 10060290 - DNA, 22 bp, Homo sapiens
caccaggctgaaccagagggga

SEQ ID NO: 10060291 - DNA, 20 bp, Homo sapiens
gctgggctttgactgacaca

SEQ ID NO: 10060292 - DNA, 22 bp, Homo sapiens
gccatgcttggtatgctgtgag

SEQ ID NO: 10060293 - DNA, 22 bp, Homo sapiens
gcccaggagttgaagggctgac

SEQ ID NO: 10060294 - DNA, 22 bp, Homo sapiens
gccagctggaaatctgcttgaa

SEQ ID NO: 10060295 - DNA, 21 bp, Homo sapiens
gcagagaatgaactttggctt

SEQ ID NO: 10060296 - DNA, 22 bp, Homo sapiens
gcacccagaataaggacaggac

SEQ ID NO: 10060297 - DNA, 22 bp, Homo sapiens
gaggctccagcgacacctaggc

SEQ ID NO: 10060298 - DNA, 22 bp, Homo sapiens
gaggaggggacagtacttgtgc

SEQ ID NO: 10060299 - DNA, 22 bp, Homo sapiens
gaggaggggcacttgtctccta

SEQ ID NO: 10060300 - DNA, 23 bp, Homo sapiens
gaggagggtcgtgctgtgttcct

SEQ ID NO: 10060301 - DNA, 22 bp, Homo sapiens
gaggagggcctggtgtcccttc

SEQ ID NO: 10060302 - DNA, 22 bp, Homo sapiens
gaggagggagctggaagctctt

SEQ ID NO: 10060303 - DNA, 22 bp, Homo sapiens
gagctgcagacatagataagcg

SEQ ID NO: 10060304 - DNA, 22 bp, Homo sapiens
gagctgcagagctcgaaggaac

SEQ ID NO: 10060305 - DNA, 22 bp, Homo sapiens
gagctgcagacttgatacagga

SEQ ID NO: 10060306 - DNA, 22 bp, Homo sapiens
gagctgcacatctgaggctaat

SEQ ID NO: 10060307 - DNA, 22 bp, Homo sapiens
gagcccagtctgctcctgcgcc

SEQ ID NO: 10060308 - DNA, 22 bp, Homo sapiens
aagctgcaggttgaatccaggt

SEQ ID NO: 10060309 - DNA, 22 bp, Homo sapiens
aagctgcagcacagagaggtgg

SEQ ID NO: 10060310 - DNA, 22 bp, Homo sapiens
aagggaaatcctcagcccagga

SEQ ID NO: 10060311 - DNA, 22 bp, Homo sapiens
aagggaaaatagttgatgacca

SEQ ID NO: 10060312 - DNA, 22 bp, Homo sapiens
accccaggcccagggaagaggc

SEQ ID NO: 10060313 - DNA, 22 bp, Homo sapiens
accccaggtcatctgagagtcc

SEQ ID NO: 10060314 - DNA, 22 bp, Homo sapiens
accccaggaagtggaggtcatg

SEQ ID NO: 10060315 - DNA, 22 bp, Homo sapiens
actcccaggttgcctggcaggc

SEQ ID NO: 10060316 - DNA, 20 bp, Homo sapiens
actccaggtggcatgaggac

SEQ ID NO: 10060317 - DNA, 22 bp, Homo sapiens
agagctggggcataaatgccac

SEQ ID NO: 10060318 - DNA, 22 bp, Homo sapiens
agccacagtcaacctgtccata

SEQ ID NO: 10060319 - DNA, 22 bp, Homo sapiens
agcctgagtgcttaggactgtt

SEQ ID NO: 10060320 - DNA, 23 bp, Homo sapiens
acacaggatacatacggaagcaa

SEQ ID NO: 10060321 - DNA, 22 bp, Homo sapiens
aaagctggcctctcaggcttta

SEQ ID NO: 10060322 - DNA, 22 bp, Homo sapiens
aaagctgggggccctggtctag

SEQ ID NO: 10060323 - DNA, 22 bp, Homo sapiens
aaagctgggctaggtttgtttc

SEQ ID NO: 10060324 - DNA, 22 bp, Homo sapiens
aaagctgggctggccaacccag

SEQ ID NO: 10060325 - DNA, 22 bp, Homo sapiens
aacagcagggacttgaatggaa

SEQ ID NO: 10060326 - DNA, 22 bp, Homo sapiens
aagctgaggcccatggcaaggt

SEQ ID NO: 10060327 - DNA, 22 bp, Homo sapiens
atggcagcctgtggacagtcaa

SEQ ID NO: 10060328 - DNA, 22 bp, Homo sapiens
atggcagcctgagcagaggaat

SEQ ID NO: 10060329 - DNA, 22 bp, Homo sapiens
cacccaggctggagtgcagggg

SEQ ID NO: 10060330 - DNA, 22 bp, Homo sapiens
cacccaggctggagagcagtgg

SEQ ID NO: 10060331 - DNA, 22 bp, Homo sapiens
cacccaggctggaatgcagtgg

SEQ ID NO: 10060332 - DNA, 22 bp, Homo sapiens
cacccagggctgtgcctgccca

SEQ ID NO: 10060333 - DNA, 22 bp, Homo sapiens
cacccaggctggagtgcagtgg

SEQ ID NO: 10060334 - DNA, 22 bp, Homo sapiens
cacccaggctggagtgcattgg

SEQ ID NO: 10060335 - DNA, 22 bp, Homo sapiens
cacccaggctggattgcagtgg

SEQ ID NO: 10060336 - DNA, 22 bp, Homo sapiens
cacccaggctggagtgcagtga

SEQ ID NO: 10060337 - DNA, 22 bp, Homo sapiens
agcccaggagtttgaggctgtg

SEQ ID NO: 10060338 - DNA, 22 bp, Homo sapiens
agccacagtgggctaccagctc

SEQ ID NO: 10060339 - DNA, 22 bp, Homo sapiens
agctggcagaaagctttgcccg

SEQ ID NO: 10060340 - DNA, 22 bp, Homo sapiens
agctggcaatgtaagtccctgg

SEQ ID NO: 10060341 - DNA, 22 bp, Homo sapiens
acccaggctggcagaggctcct

SEQ ID NO: 10060342 - DNA, 22 bp, Homo sapiens
acccaggctggagtgcagtgac

SEQ ID NO: 10060343 - DNA, 22 bp, Homo sapiens
acccaggctggagtgcagtgtc

SEQ ID NO: 10060344 - DNA, 22 bp, Homo sapiens
acccaggctggagtgcagtggt

SEQ ID NO: 10060345 - DNA, 22 bp, Homo sapiens
acccaggctggagtgcagtggg

SEQ ID NO: 10060346 - DNA, 22 bp, Homo sapiens
acccaggctggagtgcagtgat

SEQ ID NO: 10060347 - DNA, 22 bp, Homo sapiens
acccaggctggagtgcagtggc

SEQ ID NO: 10060348 - DNA, 22 bp, Homo sapiens
acccaggacaaaataaccaggt

SEQ ID NO: 10060349 - DNA, 22 bp, Homo sapiens
acccagctgtttcccgtgtcat

SEQ ID NO: 10060350 - DNA, 22 bp, Homo sapiens
acccagctggatgcatggaggc

SEQ ID NO: 10060351 - DNA, 20 bp, Homo sapiens
acccagctctgtgccctggg

SEQ ID NO: 10060352 - DNA, 22 bp, Homo sapiens
acccaggacatgggcacccgtg

SEQ ID NO: 10060353 - DNA, 22 bp, Homo sapiens
acccaggacttggcaacctcat

SEQ ID NO: 10060354 - DNA, 22 bp, Homo sapiens
acccaggagacggaggtgcagt

SEQ ID NO: 10060355 - DNA, 22 bp, Homo sapiens
acctggcacacactggggagtg

SEQ ID NO: 10060356 - DNA, 22 bp, Homo sapiens
acctggcataagggcttgagtc

SEQ ID NO: 10060357 - DNA, 22 bp, Homo sapiens
acctggcatgaagcatgcctta

SEQ ID NO: 10060358 - DNA, 22 bp, Homo sapiens
acctggcacagagtatgctctc

SEQ ID NO: 10060359 - DNA, 22 bp, Homo sapiens
acctggcacattctaccacagt

SEQ ID NO: 10060360 - DNA, 22 bp, Homo sapiens
acctggcaggaaggtgggtgat

SEQ ID NO: 10060361 - DNA, 22 bp, Homo sapiens
acctggcactacaggcacctgt

SEQ ID NO: 10060362 - DNA, 22 bp, Homo sapiens
acgcccagactcccatactttg

SEQ ID NO: 10060363 - DNA, 22 bp, Homo sapiens
actgcagaggtggggtgcagag

SEQ ID NO: 10060364 - DNA, 20 bp, Homo sapiens
actcctggtaacttttgtga

SEQ ID NO: 10060365 - DNA, 22 bp, Homo sapiens
actgtacctcaaactctggaac

SEQ ID NO: 10060366 - DNA, 22 bp, Homo sapiens
tcctcaaaggatacccaggctt

SEQ ID NO: 10060367 - DNA, 22 bp, Homo sapiens
tcctcacacccataccactgac

SEQ ID NO: 10060368 - DNA, 22 bp, Homo sapiens
tcctcacaagcatcctgtctca

SEQ ID NO: 10060369 - DNA, 22 bp, Homo sapiens
tccctggcagctaagggtggtc

SEQ ID NO: 10060370 - DNA, 22 bp, Homo sapiens
tccctggcactgctgtgattag

SEQ ID NO: 10060371 - DNA, 22 bp, Homo sapiens
tccctggcacaagaaggctgtc

SEQ ID NO: 10060372 - DNA, 22 bp, Homo sapiens
tccctggcagctgtcctttcag

SEQ ID NO: 10060373 - DNA, 22 bp, Homo sapiens
tcccaggcaggtgacaggggga

SEQ ID NO: 10060374 - DNA, 22 bp, Homo sapiens
tagtgccctcccctttgggata

SEQ ID NO: 10060375 - DNA, 22 bp, Homo sapiens
tagggcagagtccaggatgggc

SEQ ID NO: 10060376 - DNA, 22 bp, Homo sapiens
gtgccactgcactctagcctag

SEQ ID NO: 10060377 - DNA, 22 bp, Homo sapiens
gtcactgtatccaggttccagc

SEQ ID NO: 10060378 - DNA, 22 bp, Homo sapiens
gtcacctgaggggaggtgacag

SEQ ID NO: 10060379 - DNA, 22 bp, Homo sapiens
gtcctggcccaggagtacacat

SEQ ID NO: 10060380 - DNA, 22 bp, Homo sapiens
ggtccctgcctgaggctggcct

SEQ ID NO: 10060381 - DNA, 22 bp, Homo sapiens
ggtccctgctgaagccttggtg

SEQ ID NO: 10060382 - DNA, 21 bp, Homo sapiens
ggcagcctgacccccagagag

SEQ ID NO: 10060383 - DNA, 22 bp, Homo sapiens
ggcagcctccagggcactggtg

SEQ ID NO: 10060384 - DNA, 22 bp, Homo sapiens
ggcagctcctcctagtctgccc

SEQ ID NO: 10060385 - DNA, 22 bp, Homo sapiens
ggccagcagacctcagggactc

SEQ ID NO: 10060386 - DNA, 21 bp, Homo sapiens
ggctgcagggagccctggggt

SEQ ID NO: 10060387 - DNA, 22 bp, Homo sapiens
ggctgcaggcttccctccagca

SEQ ID NO: 10060388 - DNA, 17 bp, Homo sapiens
ggctgcagtccaggagg

SEQ ID NO: 10060389 - DNA, 22 bp, Homo sapiens
ggctgcagggcagctggtgtgg

SEQ ID NO: 10060390 - DNA, 22 bp, Homo sapiens
gggctctggacccaggcaagag

SEQ ID NO: 10060391 - DNA, 21 bp, Homo sapiens
gcctgcagaccccaccaggct

SEQ ID NO: 10060392 - DNA, 22 bp, Homo sapiens
gcccaagccggagctgggagag

SEQ ID NO: 10060393 - DNA, 22 bp, Homo sapiens
gcccaagctggactgcagtggc

SEQ ID NO: 10060394 - DNA, 22 bp, Homo sapiens
gcccaagctccgcctcctgtcg

SEQ ID NO: 10060395 - DNA, 22 bp, Homo sapiens
gccaggaaggctccctggtcac

SEQ ID NO: 10060396 - DNA, 18 bp, Homo sapiens
gccaggaagcatggggac

SEQ ID NO: 10060397 - DNA, 22 bp, Homo sapiens
gccaggaagtcagccaagccca

SEQ ID NO: 10060398 - DNA, 22 bp, Homo sapiens
gccaggaatcactgctgagtaa

SEQ ID NO: 10060399 - DNA, 22 bp, Homo sapiens
gccaggaagttgggccagtcta

SEQ ID NO: 10060400 - DNA, 22 bp, Homo sapiens
gccaggaagtgcagccctgcca

SEQ ID NO: 10060401 - DNA, 22 bp, Homo sapiens
gccaggaaaagaagctggtgct

SEQ ID NO: 10060402 - DNA, 22 bp, Homo sapiens
gccaggaaaaaccggccctgct

SEQ ID NO: 10060403 - DNA, 20 bp, Homo sapiens
gcaggtccctggcatgcaga

SEQ ID NO: 10060404 - DNA, 22 bp, Homo sapiens
gcacccagaggtcagcagtgct

SEQ ID NO: 10060405 - DNA, 22 bp, Homo sapiens
gcctggcagcctccaaccttca

SEQ ID NO: 10060406 - DNA, 22 bp, Homo sapiens
gcctggcaggaatctcagtgct

SEQ ID NO: 10060407 - DNA, 22 bp, Homo sapiens
gcctggcacgggctcggcccac

SEQ ID NO: 10060408 - DNA, 22 bp, Homo sapiens
gcctggcactcaatcatctgct

SEQ ID NO: 10060409 - DNA, 22 bp, Homo sapiens
gcctggcactcactgaagaggc

SEQ ID NO: 10060410 - DNA, 22 bp, Homo sapiens
gcctggcagattgacatagcca

SEQ ID NO: 10060411 - DNA, 22 bp, Homo sapiens
gcctggcactgggctcctggcc

SEQ ID NO: 10060412 - DNA, 20 bp, Homo sapiens
gcctggcacccggggctggc

SEQ ID NO: 10060413 - DNA, 22 bp, Homo sapiens
gcctggcaccacagcctttcag

SEQ ID NO: 10060414 - DNA, 22 bp, Homo sapiens
gctggcagtcccatcagctggg

SEQ ID NO: 10060415 - DNA, 22 bp, Homo sapiens
gctggcagtaaagggtttggca

SEQ ID NO: 10060416 - DNA, 22 bp, Homo sapiens
gctggcagtgtattgttagctg

SEQ ID NO: 10060417 - DNA, 22 bp, Homo sapiens
gctggcaggtaaagccccgggg

SEQ ID NO: 10060418 - DNA, 22 bp, Homo sapiens
gctggcagggttctcactgaaa

SEQ ID NO: 10060419 - DNA, 20 bp, Homo sapiens
ggagctgccctgggctggag

SEQ ID NO: 10060420 - DNA, 21 bp, Homo sapiens
ggagctgcaggagccgaaggc

SEQ ID NO: 10060421 - DNA, 18 bp, Homo sapiens
ggacaggagacatgggtg

SEQ ID NO: 10060422 - DNA, 22 bp, Homo sapiens
ggacaggataagagacactgcc

SEQ ID NO: 10060423 - DNA, 22 bp, Homo sapiens
cgtgtggacatgactagctgcc

SEQ ID NO: 10060424 - DNA, 22 bp, Homo sapiens
tgtcagagcaaggccaggccag

SEQ ID NO: 10060425 - DNA, 22 bp, Homo sapiens
cgctgcagatgggagctggttg

SEQ ID NO: 10060426 - DNA, 22 bp, Homo sapiens
cggggccctggggctgaaggtc

SEQ ID NO: 10060427 - DNA, 22 bp, Homo sapiens
ctgagcagtgctttgcagtggg

SEQ ID NO: 10060428 - DNA, 22 bp, Homo sapiens
ctgaggcctggtgaggtggtga

SEQ ID NO: 10060429 - DNA, 22 bp, Homo sapiens
ctggaagaggaagccagctgga

SEQ ID NO: 10060430 - DNA, 22 bp, Homo sapiens
ctgctctgtggtccatgagaca

SEQ ID NO: 10060431 - DNA, 22 bp, Homo sapiens
ctctgaaagacaagctctcatt

SEQ ID NO: 10060432 - DNA, 19 bp, Homo sapiens
ctgtgggcggaggaggggc

SEQ ID NO: 10060433 - DNA, 23 bp, Homo sapiens
ctgtggccacccctagctggagg

SEQ ID NO: 10060434 - DNA, 22 bp, Homo sapiens
ctgtggcaaatgatacctccca

SEQ ID NO: 10060435 - DNA, 22 bp, Homo sapiens
ctgtccctcagttctgggcaaa

SEQ ID NO: 10060436 - DNA, 22 bp, Homo sapiens
ctgggagtggtgacagctctcg

SEQ ID NO: 10060437 - DNA, 22 bp, Homo sapiens
ctgggctcctaaccatccaggt

SEQ ID NO: 10060438 - DNA, 22 bp, Homo sapiens
ctgggctccactcccacagtgt

SEQ ID NO: 10060439 - DNA, 22 bp, Homo sapiens
ctggggctggtgaggcaggctc

SEQ ID NO: 10060440 - DNA, 22 bp, Homo sapiens
ctgggctctaagggagcaccgt

SEQ ID NO: 10060441 - DNA, 22 bp, Homo sapiens
ctggtgtccgcaacgggcagcg

SEQ ID NO: 10060442 - DNA, 19 bp, Homo sapiens
gactccaactttaagcatg

SEQ ID NO: 10060443 - DNA, 22 bp, Homo sapiens
gacagtgacagcttggaaagca

SEQ ID NO: 10060444 - DNA, 22 bp, Homo sapiens
gagggaccccaggctggccctt

SEQ ID NO: 10060445 - DNA, 22 bp, Homo sapiens
ccagggtctctgctgcctgaga

SEQ ID NO: 10060446 - DNA, 21 bp, Homo sapiens
ccagggtccagctgccatggt

SEQ ID NO: 10060447 - DNA, 22 bp, Homo sapiens
tgacagagacttcagagccaaa

SEQ ID NO: 10060448 - DNA, 22 bp, Homo sapiens
tctgcagagattctgggctgag

SEQ ID NO: 10060449 - DNA, 22 bp, Homo sapiens
tctgcagagacaaagtgttatt

SEQ ID NO: 10060450 - DNA, 17 bp, Homo sapiens
tctgcagaggcaaacct

SEQ ID NO: 10060451 - DNA, 22 bp, Homo sapiens
tctgcagagcctcaggagaaca

SEQ ID NO: 10060452 - DNA, 22 bp, Homo sapiens
tctgcagagcattatagcaaaa

SEQ ID NO: 10060453 - DNA, 23 bp, Homo sapiens
tctgcagacgctgttctattgtc

SEQ ID NO: 10060454 - DNA, 19 bp, Homo sapiens
tctgcagactatattgtga

SEQ ID NO: 10060455 - DNA, 22 bp, Homo sapiens
tctgcagaattcgaggaagaaa

SEQ ID NO: 10060456 - DNA, 22 bp, Homo sapiens
tctgcagacactggggtctgga

SEQ ID NO: 10060457 - DNA, 22 bp, Homo sapiens
tctgcagaattgtctcaagcta

SEQ ID NO: 10060458 - DNA, 22 bp, Homo sapiens
tctgcagaggtaatttacagat

SEQ ID NO: 10060459 - DNA, 20 bp, Homo sapiens
tctgcagataagggaaagac

SEQ ID NO: 10060460 - DNA, 22 bp, Homo sapiens
tctgcagatccctttagtgagg

SEQ ID NO: 10060461 - DNA, 22 bp, Homo sapiens
cccaggaattggaggctgcagt

SEQ ID NO: 10060462 - DNA, 22 bp, Homo sapiens
cccaaagcagggtcattgggcc

SEQ ID NO: 10060463 - DNA, 20 bp, Homo sapiens
cccaaagcttcatatgagcc

SEQ ID NO: 10060464 - DNA, 22 bp, Homo sapiens
ccctggaggaaaatctgaggct

SEQ ID NO: 10060465 - DNA, 22 bp, Homo sapiens
ccctgtcacaatggatgacatt

SEQ ID NO: 10060466 - DNA, 22 bp, Homo sapiens
ccggagtgtctggcctgctggg

SEQ ID NO: 10060467 - DNA, 22 bp, Homo sapiens
ccgggagcaggcgccaccgcca

SEQ ID NO: 10060468 - DNA, 20 bp, Homo sapiens
cctcacagggcagagagggg

SEQ ID NO: 10060469 - DNA, 22 bp, Homo sapiens
cccgtgtgtgcgaggctcccgc

SEQ ID NO: 10060470 - DNA, 22 bp, Homo sapiens
ccctgcagtcctttcttggctc

SEQ ID NO: 10060471 - DNA, 22 bp, Homo sapiens
ccctgcagaccaatgccataga

SEQ ID NO: 10060472 - DNA, 22 bp, Homo sapiens
ccctgcagagggatgggggcag

SEQ ID NO: 10060473 - DNA, 22 bp, Homo sapiens
tggaggtgagtgtggtacagca

SEQ ID NO: 10060474 - DNA, 22 bp, Homo sapiens
cctgccaggcgagtctaggcca

SEQ ID NO: 10060475 - DNA, 22 bp, Homo sapiens
tggtctgctgaacagccgtatc

SEQ ID NO: 10060476 - DNA, 20 bp, Homo sapiens
tggggtcctggaggggatcc

SEQ ID NO: 10060477 - DNA, 22 bp, Homo sapiens
cctgcagaagagtccagctcat

SEQ ID NO: 10060478 - DNA, 22 bp, Homo sapiens
cctgaggctccacctccagaga

SEQ ID NO: 10060479 - DNA, 22 bp, Homo sapiens
tctcctggctcaccaggctgga

SEQ ID NO: 10060480 - DNA, 22 bp, Homo sapiens
tctgcagaaggaatcagctgag

SEQ ID NO: 10060481 - DNA, 19 bp, Homo sapiens
tctgcagaaggcatacatg

SEQ ID NO: 10060482 - DNA, 22 bp, Homo sapiens
tcgcccaggctggaagtgcagt

SEQ ID NO: 10060483 - DNA, 22 bp, Homo sapiens
tcccaggaggtgcttcctagga

SEQ ID NO: 10060484 - DNA, 22 bp, Homo sapiens
ttgggcagtctggctgcagagt

SEQ ID NO: 10060485 - DNA, 22 bp, Homo sapiens
ttggcagcagggagttggccgc

SEQ ID NO: 10060486 - DNA, 20 bp, Homo sapiens
ttggcagcagttccaagtga

SEQ ID NO: 10060487 - DNA, 22 bp, Homo sapiens
ttggcagcggggaccctggctg

SEQ ID NO: 10060488 - DNA, 23 bp, Homo sapiens
ttggcagcgggtcaggctgtggg

SEQ ID NO: 10060489 - DNA, 22 bp, Homo sapiens
ttggcagcattccagccaagca

SEQ ID NO: 10060490 - DNA, 22 bp, Homo sapiens
ttggcagctcttgatggcaccc

SEQ ID NO: 10060491 - DNA, 22 bp, Homo sapiens
ttggcagctgttggaccttgac

SEQ ID NO: 10060492 - DNA, 22 bp, Homo sapiens
ttgtcctgcaacctcacatggc

SEQ ID NO: 10060493 - DNA, 22 bp, Homo sapiens
ttgcagcccgggttggtttgtg

SEQ ID NO: 10060494 - DNA, 22 bp, Homo sapiens
gagcctggggaccctcctgagt

SEQ ID NO: 10060495 - DNA, 18 bp, Homo sapiens
gaccccgggatctgtcga

SEQ ID NO: 10060496 - DNA, 22 bp, Homo sapiens
gcactgggggcagcagtgaggg

SEQ ID NO: 10060497 - DNA, 23 bp, Homo sapiens
gcactgggctctcagcaaggtgt

SEQ ID NO: 10060498 - DNA, 22 bp, Homo sapiens
gcactgtgacccagagcaggtg

SEQ ID NO: 10060499 - DNA, 22 bp, Homo sapiens
gcagggtccatggaggcagccc

SEQ ID NO: 10060500 - DNA, 22 bp, Homo sapiens
gcagggtctgaggccacagagg

SEQ ID NO: 10060501 - DNA, 22 bp, Homo sapiens
gcagggtcttgagaggcagcca

SEQ ID NO: 10060502 - DNA, 22 bp, Homo sapiens
gcaggatgggtgtagcccagca

SEQ ID NO: 10060503 - DNA, 19 bp, Homo sapiens
gccctgcaggaggtggggc

SEQ ID NO: 10060504 - DNA, 22 bp, Homo sapiens
gtgcagcctgtcgccagtggat

SEQ ID NO: 10060505 - DNA, 22 bp, Homo sapiens
cagctctgagactgaggctatg

SEQ ID NO: 10060506 - DNA, 22 bp, Homo sapiens
gctggcagagagctggtgagga

SEQ ID NO: 10060507 - DNA, 22 bp, Homo sapiens
gctggcagcattagaccctggg

SEQ ID NO: 10060508 - DNA, 19 bp, Homo sapiens
gctggcagatgtggccgtg

SEQ ID NO: 10060509 - DNA, 22 bp, Homo sapiens
gctggcagagctctgggctggg

SEQ ID NO: 10060510 - DNA, 20 bp, Homo sapiens
gctggcagatgtcttgagat

SEQ ID NO: 10060511 - DNA, 22 bp, Homo sapiens
gctgggagccccgagccagcgc

SEQ ID NO: 10060512 - DNA, 19 bp, Homo sapiens
gctgggagcagaccctccc

SEQ ID NO: 10060513 - DNA, 22 bp, Homo sapiens
ggagagtggattccagctgtat

SEQ ID NO: 10060514 - DNA, 22 bp, Homo sapiens
cacccaggaggttgggaagggc

SEQ ID NO: 10060515 - DNA, 22 bp, Homo sapiens
cacccaggcaaggattctgcaa

SEQ ID NO: 10060516 - DNA, 22 bp, Homo sapiens
cacccaggacaggccagatgtg

SEQ ID NO: 10060517 - DNA, 22 bp, Homo sapiens
cacccaggacaaaatatggaat

SEQ ID NO: 10060518 - DNA, 22 bp, Homo sapiens
cacccaggcaggtggctgagaa

SEQ ID NO: 10060519 - DNA, 22 bp, Homo sapiens
ggctgcagatagccagccacca

SEQ ID NO: 10060520 - DNA, 22 bp, Homo sapiens
ggctgcagccctcgcctagcca

SEQ ID NO: 10060521 - DNA, 22 bp, Homo sapiens
ggctgcagattgtagtctgtta

SEQ ID NO: 10060522 - DNA, 22 bp, Homo sapiens
ggcgctcagtgttgccccagag

SEQ ID NO: 10060523 - DNA, 22 bp, Homo sapiens
ccactgggggctgcaggcactc

SEQ ID NO: 10060524 - DNA, 19 bp, Homo sapiens
ccactggggctccacatta

SEQ ID NO: 10060525 - DNA, 22 bp, Homo sapiens
ccagaccctttcttggcatgtg

SEQ ID NO: 10060526 - DNA, 22 bp, Homo sapiens
aggccatgtggccccagagtct

SEQ ID NO: 10060527 - DNA, 22 bp, Homo sapiens
ccagctggaacggcagcccagc

SEQ ID NO: 10060528 - DNA, 22 bp, Homo sapiens
ccaggaagtatgacccaacaga

SEQ ID NO: 10060529 - DNA, 18 bp, Homo sapiens
aggcctgggaagctgagg

SEQ ID NO: 10060530 - DNA, 22 bp, Homo sapiens
aggcctggcatgagacctgaga

SEQ ID NO: 10060531 - DNA, 22 bp, Homo sapiens
ccctaggctgaggccagggtgc

SEQ ID NO: 10060532 - DNA, 22 bp, Homo sapiens
cccatgggttttcctccctgcc

SEQ ID NO: 10060533 - DNA, 22 bp, Homo sapiens
agctgccgatgcccagctgcat

SEQ ID NO: 10060534 - DNA, 22 bp, Homo sapiens
aggaggtgttgatagaaggttt

SEQ ID NO: 10060535 - DNA, 22 bp, Homo sapiens
aggagctggcctagaaaggaga

SEQ ID NO: 10060536 - DNA, 22 bp, Homo sapiens
aggcacagtttcatccccgggc

SEQ ID NO: 10060537 - DNA, 22 bp, Homo sapiens
ctgcagggaactgaggcccaga

SEQ ID NO: 10060538 - DNA, 22 bp, Homo sapiens
ctggcaagtactgggccagctc

SEQ ID NO: 10060539 - DNA, 20 bp, Homo sapiens
ctggccagaacgcctacaca

SEQ ID NO: 10060540 - DNA, 22 bp, Homo sapiens
ctggtcaggaaggtggggacag

SEQ ID NO: 10060541 - DNA, 22 bp, Homo sapiens
ctggtcagggtagtgttgcaga

SEQ ID NO: 10060542 - DNA, 20 bp, Homo sapiens
ctgggaggtcttccaaatca

SEQ ID NO: 10060543 - DNA, 22 bp, Homo sapiens
cctgggagggcaagtgctgatg

SEQ ID NO: 10060544 - DNA, 22 bp, Homo sapiens
acagcccagctctttctctgca

SEQ ID NO: 10060545 - DNA, 22 bp, Homo sapiens
agctgcagccgcagctgtggcc

SEQ ID NO: 10060546 - DNA, 22 bp, Homo sapiens
agctgcagcctcatgattcggt

SEQ ID NO: 10060547 - DNA, 22 bp, Homo sapiens
agctgcagccctcctgcatggc

SEQ ID NO: 10060548 - DNA, 22 bp, Homo sapiens
acagcccaagtcacctgcagga

SEQ ID NO: 10060549 - DNA, 22 bp, Homo sapiens
agctgcagctacagtgttggtt

SEQ ID NO: 10060550 - DNA, 22 bp, Homo sapiens
agctgcaggagtcgcctaggat

SEQ ID NO: 10060551 - DNA, 22 bp, Homo sapiens
agctgcaggattatggaatgga

SEQ ID NO: 10060552 - DNA, 22 bp, Homo sapiens
agctgggactcaactgtctggg

SEQ ID NO: 10060553 - DNA, 22 bp, Homo sapiens
agctgggaggctcctctgtgac

SEQ ID NO: 10060554 - DNA, 22 bp, Homo sapiens
agctgggatgaggagcatcctt

SEQ ID NO: 10060555 - DNA, 22 bp, Homo sapiens
agctgtggtgttttcaagccct

SEQ ID NO: 10060556 - DNA, 22 bp, Homo sapiens
aggcacagagaatgccctccat

SEQ ID NO: 10060557 - DNA, 22 bp, Homo sapiens
accctggcccattgctgtgcct

SEQ ID NO: 10060558 - DNA, 22 bp, Homo sapiens
accctggcctggttcatgtgat

SEQ ID NO: 10060559 - DNA, 22 bp, Homo sapiens
acccaggctggcgtgcagtggc

SEQ ID NO: 10060560 - DNA, 22 bp, Homo sapiens
aggcccagggctgctctctgaa

SEQ ID NO: 10060561 - DNA, 22 bp, Homo sapiens
actctctgtctaaatgcagttt

SEQ ID NO: 10060562 - DNA, 22 bp, Homo sapiens
agaggcacggaggctgcatgga

SEQ ID NO: 10060563 - DNA, 22 bp, Homo sapiens
agaggcactaagggaagagcag

SEQ ID NO: 10060564 - DNA, 22 bp, Homo sapiens
agaggcacccgcgcgcggccat

SEQ ID NO: 10060565 - DNA, 22 bp, Homo sapiens
agaggcacagaggcagtcccct

SEQ ID NO: 10060566 - DNA, 22 bp, Homo sapiens
agaggcacaacagtcccattgt

SEQ ID NO: 10060567 - DNA, 22 bp, Homo sapiens
agagtgcccaagcctggcaggg

SEQ ID NO: 10060568 - DNA, 22 bp, Homo sapiens
agcactcctgtctttccccttt

SEQ ID NO: 10060569 - DNA, 22 bp, Homo sapiens
cactggtgacttctgagctgga

SEQ ID NO: 10060570 - DNA, 22 bp, Homo sapiens
agcatggggcaatgcatgtgct

SEQ ID NO: 10060571 - DNA, 22 bp, Homo sapiens
agcccagggacagggcggatgt

SEQ ID NO: 10060572 - DNA, 22 bp, Homo sapiens
agcccagggaaccaggaagtgg

SEQ ID NO: 10060573 - DNA, 21 bp, Homo sapiens
agcctgggtatcctttgagga

SEQ ID NO: 10060574 - DNA, 22 bp, Homo sapiens
agcctgggttagggttcttccc

SEQ ID NO: 10060575 - DNA, 22 bp, Homo sapiens
agcctgggtgggggttcggaga

SEQ ID NO: 10060576 - DNA, 22 bp, Homo sapiens
agcctgggtttttattaaggag

SEQ ID NO: 10060577 - DNA, 23 bp, Homo sapiens
agcctgggtagcctaaataacag

SEQ ID NO: 10060578 - DNA, 22 bp, Homo sapiens
agcctggggtttcagtttgcac

SEQ ID NO: 10060579 - DNA, 22 bp, Homo sapiens
agcctgggggcgcagaaaccgg

SEQ ID NO: 10060580 - DNA, 22 bp, Homo sapiens
agcctggggcacttctccaaac

SEQ ID NO: 10060581 - DNA, 18 bp, Homo sapiens
agcctgggctctgcctgg

SEQ ID NO: 10060582 - DNA, 20 bp, Homo sapiens
agcctggggaattccacccc

SEQ ID NO: 10060583 - DNA, 22 bp, Homo sapiens
agcctgggcatgggacgggagg

SEQ ID NO: 10060584 - DNA, 22 bp, Homo sapiens
agcctgggccctgcctcttctc

SEQ ID NO: 10060585 - DNA, 22 bp, Homo sapiens
agcctgggcctggcttcccgcc

SEQ ID NO: 10060586 - DNA, 21 bp, Homo sapiens
agcctgggaggcggaggttgc

SEQ ID NO: 10060587 - DNA, 22 bp, Homo sapiens
agcctgggcaactccattcact

SEQ ID NO: 10060588 - DNA, 22 bp, Homo sapiens
agcctgggcaacaacacagcga

SEQ ID NO: 10060589 - DNA, 22 bp, Homo sapiens
agcctgggcaacagagcaaaac

SEQ ID NO: 10060590 - DNA, 22 bp, Homo sapiens
agcctgggagacactaagttgt

SEQ ID NO: 10060591 - DNA, 17 bp, Homo sapiens
agcctgggaaggagtga

SEQ ID NO: 10060592 - DNA, 22 bp, Homo sapiens
agcctgggaatttagagttcgg

SEQ ID NO: 10060593 - DNA, 19 bp, Homo sapiens
agcctggctttgctctgct

SEQ ID NO: 10060594 - DNA, 22 bp, Homo sapiens
agcctggcttagctctctcact

SEQ ID NO: 10060595 - DNA, 22 bp, Homo sapiens
agcaggagctgtgggaagatgg

SEQ ID NO: 10060596 - DNA, 22 bp, Homo sapiens
agcctgtgtgctttggacaggg

SEQ ID NO: 10060597 - DNA, 22 bp, Homo sapiens
agcctggctgtaacctcatggt

SEQ ID NO: 10060598 - DNA, 22 bp, Homo sapiens
agcccaggtctggcccagcctg

SEQ ID NO: 10060599 - DNA, 22 bp, Homo sapiens
actgtggcaaagaagcaggctc

SEQ ID NO: 10060600 - DNA, 22 bp, Homo sapiens
actgtggctcagggaatgcatg

SEQ ID NO: 10060601 - DNA, 17 bp, Homo sapiens
accttgcagtgtgccgg

SEQ ID NO: 10060602 - DNA, 22 bp, Homo sapiens
accttgcagtggaggtttagtg

SEQ ID NO: 10060603 - DNA, 22 bp, Homo sapiens
aagagtcctgttacacatgagt

SEQ ID NO: 10060604 - DNA, 22 bp, Homo sapiens
acacccaggctggcgtgcagtg

SEQ ID NO: 10060605 - DNA, 22 bp, Homo sapiens
aagcaaaacgtgctctaggagg

SEQ ID NO: 10060606 - DNA, 22 bp, Homo sapiens
aagccatttcctgatacaccta

SEQ ID NO: 10060607 - DNA, 22 bp, Homo sapiens
aagctgggacttagcgcagata

SEQ ID NO: 10060608 - DNA, 22 bp, Homo sapiens
aagctggggactcagaccccat

SEQ ID NO: 10060609 - DNA, 22 bp, Homo sapiens
gtgccgcgacgcagtcggtgcc

SEQ ID NO: 10060610 - DNA, 22 bp, Homo sapiens
gggtcaggctagcccagacttc

SEQ ID NO: 10060611 - DNA, 23 bp, Homo sapiens
gggaagtgaggagcccctcagcc

SEQ ID NO: 10060612 - DNA, 22 bp, Homo sapiens
gggaagtgaagtgtagctgtct

SEQ ID NO: 10060613 - DNA, 23 bp, Homo sapiens
gggaagtgaggagcccctctgcc

SEQ ID NO: 10060614 - DNA, 22 bp, Homo sapiens
gggaagtgaggagcccctctgc

SEQ ID NO: 10060615 - DNA, 22 bp, Homo sapiens
gggaagtgatggagccaggatt

SEQ ID NO: 10060616 - DNA, 22 bp, Homo sapiens
gggaagtgccctcttcaggaga

SEQ ID NO: 10060617 - DNA, 23 bp, Homo sapiens
gggaagtggggatttgaagtcat

SEQ ID NO: 10060618 - DNA, 22 bp, Homo sapiens
gggaagtgtgcagagttctctt

SEQ ID NO: 10060619 - DNA, 22 bp, Homo sapiens
gggaagtgtggtttctttacag

SEQ ID NO: 10060620 - DNA, 22 bp, Homo sapiens
ggctccccaggtccaggagctg

SEQ ID NO: 10060621 - DNA, 22 bp, Homo sapiens
gctggcagaagagctggttcaa

SEQ ID NO: 10060622 - DNA, 22 bp, Homo sapiens
gctggcagaatttcttcttgct

SEQ ID NO: 10060623 - DNA, 22 bp, Homo sapiens
gctggcagactgggggcagaac

SEQ ID NO: 10060624 - DNA, 22 bp, Homo sapiens
gctggcaggagcctttcccttt

SEQ ID NO: 10060625 - DNA, 22 bp, Homo sapiens
gctggcaggagaaacggggtgc

SEQ ID NO: 10060626 - DNA, 22 bp, Homo sapiens
gctggcagctggaagttgggct

SEQ ID NO: 10060627 - DNA, 22 bp, Homo sapiens
gctggcagacttcctctggaac

SEQ ID NO: 10060628 - DNA, 22 bp, Homo sapiens
gctggcagggacagctgcgtgt

SEQ ID NO: 10060629 - DNA, 22 bp, Homo sapiens
gctgggagtcgcgtctgtggcc

SEQ ID NO: 10060630 - DNA, 22 bp, Homo sapiens
ggacacgtggctgaaggcggcc

SEQ ID NO: 10060631 - DNA, 22 bp, Homo sapiens
ggaaagtggtggtggaaagagg

SEQ ID NO: 10060632 - DNA, 22 bp, Homo sapiens
ggaagctgttgtgagtgcagca

SEQ ID NO: 10060633 - DNA, 22 bp, Homo sapiens
gcgccccatctacagtactttt

SEQ ID NO: 10060634 - DNA, 22 bp, Homo sapiens
gccttgcaggaaggagggacag

SEQ ID NO: 10060635 - DNA, 22 bp, Homo sapiens
gcgggccaccttggagagcgct

SEQ ID NO: 10060636 - DNA, 22 bp, Homo sapiens
gcgctggggctcaaacctcaca

SEQ ID NO: 10060637 - DNA, 22 bp, Homo sapiens
gcctggggtctctgactcacag

SEQ ID NO: 10060638 - DNA, 22 bp, Homo sapiens
gcctggggcatgcagctgatac

SEQ ID NO: 10060639 - DNA, 22 bp, Homo sapiens
gctgcagacctcatgcaggtgg

SEQ ID NO: 10060640 - DNA, 22 bp, Homo sapiens
gccagagaggccgaggtaccca

SEQ ID NO: 10060641 - DNA, 18 bp, Homo sapiens
gccaggtctctctgcttc

SEQ ID NO: 10060642 - DNA, 22 bp, Homo sapiens
gccaggtccagggtggagcgct

SEQ ID NO: 10060643 - DNA, 22 bp, Homo sapiens
gccaggtcgtctccatgtccaa

SEQ ID NO: 10060644 - DNA, 22 bp, Homo sapiens
gccaggaatggagaggtggcct

SEQ ID NO: 10060645 - DNA, 22 bp, Homo sapiens
gccaggaatttcaagagccact

SEQ ID NO: 10060646 - DNA, 21 bp, Homo sapiens
gcccagagtcctcccactcca

SEQ ID NO: 10060647 - DNA, 22 bp, Homo sapiens
gcccactgagtgactccctcag

SEQ ID NO: 10060648 - DNA, 22 bp, Homo sapiens
gagggtcccgagccctgtcaga

SEQ ID NO: 10060649 - DNA, 22 bp, Homo sapiens
gcaagctgatgtgatagtgaaa

SEQ ID NO: 10060650 - DNA, 22 bp, Homo sapiens
gcaagctgctcttatgtggagg

SEQ ID NO: 10060651 - DNA, 22 bp, Homo sapiens
gcaagctgtgatttatgtgaat

SEQ ID NO: 10060652 - DNA, 22 bp, Homo sapiens
gcactctcctggctgccacagt

SEQ ID NO: 10060653 - DNA, 22 bp, Homo sapiens
gcacctgggacccagaggcacc

SEQ ID NO: 10060654 - DNA, 22 bp, Homo sapiens
gcagaggagcaagctggacacc

SEQ ID NO: 10060655 - DNA, 22 bp, Homo sapiens
gcagaggacacaggagggcaag

SEQ ID NO: 10060656 - DNA, 22 bp, Homo sapiens
gcaggctcttctttctgcccag

SEQ ID NO: 10060657 - DNA, 22 bp, Homo sapiens
gcaggctcccttgcagagcagg

SEQ ID NO: 10060658 - DNA, 23 bp, Homo sapiens
gcagaggagcaagctggacacca

SEQ ID NO: 10060659 - DNA, 21 bp, Homo sapiens
tcacgtggtcacatgagcttt

SEQ ID NO: 10060660 - DNA, 23 bp, Homo sapiens
tcctcctggatacaaagggaaca

SEQ ID NO: 10060661 - DNA, 19 bp, Homo sapiens
tcccaggcaaaggcttctc

SEQ ID NO: 10060662 - DNA, 22 bp, Homo sapiens
tccctgcaggtggggtggccag

SEQ ID NO: 10060663 - DNA, 21 bp, Homo sapiens
tcccagctgggtcagtgctgc

SEQ ID NO: 10060664 - DNA, 22 bp, Homo sapiens
tcccagctgagattgagcaagg

SEQ ID NO: 10060665 - DNA, 22 bp, Homo sapiens
tcccagctgctgagatagtgct

SEQ ID NO: 10060666 - DNA, 22 bp, Homo sapiens
taggaagtggtagaggccagga

SEQ ID NO: 10060667 - DNA, 22 bp, Homo sapiens
tattttcaccatgtatccctgt

SEQ ID NO: 10060668 - DNA, 23 bp, Homo sapiens
cctggggcacttgagtcctcatc

SEQ ID NO: 10060669 - DNA, 22 bp, Homo sapiens
ctcactgtgccttttcccaaac

SEQ ID NO: 10060670 - DNA, 22 bp, Homo sapiens
ctcaggccattcttccagctgc

SEQ ID NO: 10060671 - DNA, 22 bp, Homo sapiens
ctccctggcagccgcactcctg

SEQ ID NO: 10060672 - DNA, 22 bp, Homo sapiens
ctgcagggtttttcaaggacaa

SEQ ID NO: 10060673 - DNA, 22 bp, Homo sapiens
ctgccctgcttctgagggaagc

SEQ ID NO: 10060674 - DNA, 22 bp, Homo sapiens
ctgccctgggccaggaagcggc

SEQ ID NO: 10060675 - DNA, 22 bp, Homo sapiens
ctgagctgggagcctggcacca

SEQ ID NO: 10060676 - DNA, 22 bp, Homo sapiens
ctgagggcaccgacagagtgga

SEQ ID NO: 10060677 - DNA, 20 bp, Homo sapiens
ctggtctgccactcacagtt

SEQ ID NO: 10060678 - DNA, 22 bp, Homo sapiens
ctgtcagcttctcctggccaga

SEQ ID NO: 10060679 - DNA, 22 bp, Homo sapiens
ctgtcagggggcctggccatca

SEQ ID NO: 10060680 - DNA, 22 bp, Homo sapiens
ctgggacctcggggtgatcaaa

SEQ ID NO: 10060681 - DNA, 22 bp, Homo sapiens
ctgggacctcctgaggtggagc

SEQ ID NO: 10060682 - DNA, 22 bp, Homo sapiens
ctgggagattcaggtgaagttt

SEQ ID NO: 10060683 - DNA, 22 bp, Homo sapiens
ctgggctagaaggaccaggatg

SEQ ID NO: 10060684 - DNA, 22 bp, Homo sapiens
ctgggcagctccataccaccca

SEQ ID NO: 10060685 - DNA, 22 bp, Homo sapiens
ctgggagcctggcagttgctga

SEQ ID NO: 10060686 - DNA, 22 bp, Homo sapiens
ctgggagcgcagcaggcacaac

SEQ ID NO: 10060687 - DNA, 22 bp, Homo sapiens
gagaccccagctcagcctccag

SEQ ID NO: 10060688 - DNA, 21 bp, Homo sapiens
gagagggcattataggaagtg

SEQ ID NO: 10060689 - DNA, 22 bp, Homo sapiens
gagagggccagggtgagaacta

SEQ ID NO: 10060690 - DNA, 22 bp, Homo sapiens
gactcctgcctcctctgtttgc

SEQ ID NO: 10060691 - DNA, 22 bp, Homo sapiens
gagcccagctgcggccctcagc

SEQ ID NO: 10060692 - DNA, 21 bp, Homo sapiens
cagggccaatcctgacctcta

SEQ ID NO: 10060693 - DNA, 22 bp, Homo sapiens
caggctccttcccagggatggt

SEQ ID NO: 10060694 - DNA, 20 bp, Homo sapiens
caggctccgcaggactaggg

SEQ ID NO: 10060695 - DNA, 22 bp, Homo sapiens
caggccctgccttgagggacct

SEQ ID NO: 10060696 - DNA, 22 bp, Homo sapiens
caggccctgcacagtggtcctg

SEQ ID NO: 10060697 - DNA, 22 bp, Homo sapiens
tacccagggcttttctgatgca

SEQ ID NO: 10060698 - DNA, 22 bp, Homo sapiens
tacccaggggctgagcagaggt

SEQ ID NO: 10060699 - DNA, 22 bp, Homo sapiens
tacccaggagaaacagcagggc

SEQ ID NO: 10060700 - DNA, 22 bp, Homo sapiens
tacccaggaggaaactgaggct

SEQ ID NO: 10060701 - DNA, 22 bp, Homo sapiens
cagggccaagcccctttggctg

SEQ ID NO: 10060702 - DNA, 22 bp, Homo sapiens
tccagggcatgctcagactcag

SEQ ID NO: 10060703 - DNA, 22 bp, Homo sapiens
tggcaggctctgagtagcacct

SEQ ID NO: 10060704 - DNA, 22 bp, Homo sapiens
tggcaggctgagttggcctggt

SEQ ID NO: 10060705 - DNA, 22 bp, Homo sapiens
tggcaggcggaggttgcagtga

SEQ ID NO: 10060706 - DNA, 22 bp, Homo sapiens
cccttgcatcccatgtgtggcc

SEQ ID NO: 10060707 - DNA, 22 bp, Homo sapiens
cccaggtctccctgcagccctg

SEQ ID NO: 10060708 - DNA, 22 bp, Homo sapiens
cccaggtctgccagcctgtggg

SEQ ID NO: 10060709 - DNA, 22 bp, Homo sapiens
tggcagtgggaagctggaagtc

SEQ ID NO: 10060710 - DNA, 22 bp, Homo sapiens
cctcctggcttttcccattgaa

SEQ ID NO: 10060711 - DNA, 20 bp, Homo sapiens
tctgggagggacaagtctcc

SEQ ID NO: 10060712 - DNA, 22 bp, Homo sapiens
tgaagtgcattctctggcactc

SEQ ID NO: 10060713 - DNA, 22 bp, Homo sapiens
tgcagagacttgtgtgcatttg

SEQ ID NO: 10060714 - DNA, 22 bp, Homo sapiens
tgcactccaggctgggtgacag

SEQ ID NO: 10060715 - DNA, 22 bp, Homo sapiens
tgcagctgctcattctctcagt

SEQ ID NO: 10060716 - DNA, 22 bp, Homo sapiens
tgcagctgcctagggctggctt

SEQ ID NO: 10060717 - DNA, 22 bp, Homo sapiens
ttggcagcagagtgtggtgctc

SEQ ID NO: 10060718 - DNA, 22 bp, Homo sapiens
ttggcagcaagaggctcttctg

SEQ ID NO: 10060719 - DNA, 22 bp, Homo sapiens
ttggcagcacggggaacgtctg

SEQ ID NO: 10060720 - DNA, 22 bp, Homo sapiens
ccaggcctagcccctgagggta

SEQ ID NO: 10060721 - DNA, 22 bp, Homo sapiens
aggcccagtgtggcttcctgga

SEQ ID NO: 10060722 - DNA, 22 bp, Homo sapiens
ccctgggcagtctgcacttcag

SEQ ID NO: 10060723 - DNA, 22 bp, Homo sapiens
agggccagctgatgagaatgag

SEQ ID NO: 10060724 - DNA, 22 bp, Homo sapiens
agctgcagtatgaggctggtgg

SEQ ID NO: 10060725 - DNA, 22 bp, Homo sapiens
agctgcagtaaagctctccagg

SEQ ID NO: 10060726 - DNA, 21 bp, Homo sapiens
agctgcagtcaagccagaggt

SEQ ID NO: 10060727 - DNA, 22 bp, Homo sapiens
agctgcaggcgccggggccgat

SEQ ID NO: 10060728 - DNA, 22 bp, Homo sapiens
agctgcaggcctctcctgggga

SEQ ID NO: 10060729 - DNA, 22 bp, Homo sapiens
agctgcagggcttgggtttccc

SEQ ID NO: 10060730 - DNA, 22 bp, Homo sapiens
agctgcaggttcagcattccac

SEQ ID NO: 10060731 - DNA, 22 bp, Homo sapiens
agctgaggcatggacaggctgc

SEQ ID NO: 10060732 - DNA, 21 bp, Homo sapiens
agctgcagcccaaaggcctgt

SEQ ID NO: 10060733 - DNA, 22 bp, Homo sapiens
agctgcaggcccatgctcagtc

SEQ ID NO: 10060734 - DNA, 21 bp, Homo sapiens
agctgcaggcctcccagggat

SEQ ID NO: 10060735 - DNA, 22 bp, Homo sapiens
cagggccagccgcagcatccac

SEQ ID NO: 10060736 - DNA, 22 bp, Homo sapiens
aggcacagcacacctggccccc

SEQ ID NO: 10060737 - DNA, 22 bp, Homo sapiens
cggagcctgcttgttgcagctg

SEQ ID NO: 10060738 - DNA, 22 bp, Homo sapiens
ccttggcatgtggcatgtggct

SEQ ID NO: 10060739 - DNA, 22 bp, Homo sapiens
ccttggcagtggagtgaggtgg

SEQ ID NO: 10060740 - DNA, 22 bp, Homo sapiens
ccttgctcaagctagtgacggg

SEQ ID NO: 10060741 - DNA, 21 bp, Homo sapiens
cctgccaggaaactgagtgtc

SEQ ID NO: 10060742 - DNA, 22 bp, Homo sapiens
cctctctctgcatctggagggc

SEQ ID NO: 10060743 - DNA, 22 bp, Homo sapiens
cctggaagttggaggttgcagt

SEQ ID NO: 10060744 - DNA, 20 bp, Homo sapiens
cctggaagagctccccaggc

SEQ ID NO: 10060745 - DNA, 22 bp, Homo sapiens
cctggaaggtgatggtacagca

SEQ ID NO: 10060746 - DNA, 22 bp, Homo sapiens
cctggcagcctcagccaattct

SEQ ID NO: 10060747 - DNA, 22 bp, Homo sapiens
cctggcagcccagagcgccgct

SEQ ID NO: 10060748 - DNA, 22 bp, Homo sapiens
cctggcagcgccgaagctggcc

SEQ ID NO: 10060749 - DNA, 22 bp, Homo sapiens
cctggcagctcctccccggcgg

SEQ ID NO: 10060750 - DNA, 22 bp, Homo sapiens
cctggcagcgtgccgagctgcg

SEQ ID NO: 10060751 - DNA, 22 bp, Homo sapiens
cctggcagctaagtgctttgag

SEQ ID NO: 10060752 - DNA, 22 bp, Homo sapiens
cctggcagctccgtggccttcc

SEQ ID NO: 10060753 - DNA, 22 bp, Homo sapiens
cctggctgcttcctctgccatg

SEQ ID NO: 10060754 - DNA, 22 bp, Homo sapiens
ctgcccagaatcactcactcga

SEQ ID NO: 10060755 - DNA, 22 bp, Homo sapiens
ctggcagctctactcagagcct

SEQ ID NO: 10060756 - DNA, 22 bp, Homo sapiens
ctggcagctctgagtcccttct

SEQ ID NO: 10060757 - DNA, 19 bp, Homo sapiens
ctggcagcctgtctgtgtc

SEQ ID NO: 10060758 - DNA, 22 bp, Homo sapiens
ctggcagcggtttgcagcctgg

SEQ ID NO: 10060759 - DNA, 22 bp, Homo sapiens
ctgggcaggagggctctatgga

SEQ ID NO: 10060760 - DNA, 22 bp, Homo sapiens
ctgggcagtatgaatattcaaa

SEQ ID NO: 10060761 - DNA, 22 bp, Homo sapiens
ctgggcagtggtggcatctttg

SEQ ID NO: 10060762 - DNA, 22 bp, Homo sapiens
ctgggcagtggtggcccttccc

SEQ ID NO: 10060763 - DNA, 22 bp, Homo sapiens
ctggcagctggaggctagaggc

SEQ ID NO: 10060764 - DNA, 22 bp, Homo sapiens
atccctctctgcatgactgtgt

SEQ ID NO: 10060765 - DNA, 22 bp, Homo sapiens
ctgtgcagctggcttcctggaa

SEQ ID NO: 10060766 - DNA, 22 bp, Homo sapiens
cttggcagagggctgggctcag

SEQ ID NO: 10060767 - DNA, 22 bp, Homo sapiens
gcgagcctctggagtcctctgg

SEQ ID NO: 10060768 - DNA, 22 bp, Homo sapiens
ggcagagctgcatgagcactca

SEQ ID NO: 10060769 - DNA, 22 bp, Homo sapiens
caccctgactggccctgcagga

SEQ ID NO: 10060770 - DNA, 22 bp, Homo sapiens
cacccaggttggagtgcagtgg

SEQ ID NO: 10060771 - DNA, 22 bp, Homo sapiens
cacccaggctagagtgcagtgg

SEQ ID NO: 10060772 - DNA, 22 bp, Homo sapiens
cacccaggctggaatgcaatgg

SEQ ID NO: 10060773 - DNA, 22 bp, Homo sapiens
cactgaggactcccacgtaggt

SEQ ID NO: 10060774 - DNA, 23 bp, Homo sapiens
cacacccatcactaagagctcct

SEQ ID NO: 10060775 - DNA, 19 bp, Homo sapiens
cacacccatgcttgccaag

SEQ ID NO: 10060776 - DNA, 22 bp, Homo sapiens
caaccccactacacgttggaga

SEQ ID NO: 10060777 - DNA, 22 bp, Homo sapiens
gctgcagccctgcggatcactt

SEQ ID NO: 10060778 - DNA, 22 bp, Homo sapiens
gctgcagagggaggggctcgca

SEQ ID NO: 10060779 - DNA, 22 bp, Homo sapiens
gctgcagagtgatgaagtgggg

SEQ ID NO: 10060780 - DNA, 22 bp, Homo sapiens
gctgcagactgggaggcaggtg

SEQ ID NO: 10060781 - DNA, 18 bp, Homo sapiens
gggcaagcggctgtcacc

SEQ ID NO: 10060782 - DNA, 22 bp, Homo sapiens
gggcaagcagtgaggacagcac

SEQ ID NO: 10060783 - DNA, 22 bp, Homo sapiens
cagaggcaggataagaactgcg

SEQ ID NO: 10060784 - DNA, 22 bp, Homo sapiens
cagagctgcagattgaaggcat

SEQ ID NO: 10060785 - DNA, 22 bp, Homo sapiens
cagagctgacccaaggattgaa

SEQ ID NO: 10060786 - DNA, 22 bp, Homo sapiens
cagcccagcagggtctggccct

SEQ ID NO: 10060787 - DNA, 22 bp, Homo sapiens
cagcccagagccagttcccgct

SEQ ID NO: 10060788 - DNA, 21 bp, Homo sapiens
cagcccagagcagtggggcca

SEQ ID NO: 10060789 - DNA, 22 bp, Homo sapiens
agacacagcagtgcctgcctca

SEQ ID NO: 10060790 - DNA, 22 bp, Homo sapiens
agacgcggtggtgcatgcctgt

SEQ ID NO: 10060791 - DNA, 22 bp, Homo sapiens
atgcagggaggtaagaggtgcc

SEQ ID NO: 10060792 - DNA, 22 bp, Homo sapiens
atggcagcatagtggcaagtta

SEQ ID NO: 10060793 - DNA, 18 bp, Homo sapiens
cacaggagccacactcac

SEQ ID NO: 10060794 - DNA, 22 bp, Homo sapiens
agcacagagttgctcactgccg

SEQ ID NO: 10060795 - DNA, 22 bp, Homo sapiens
aggcagcagtgataagatagga

SEQ ID NO: 10060796 - DNA, 22 bp, Homo sapiens
acccgggaggcaggagtcatag

SEQ ID NO: 10060797 - DNA, 17 bp, Homo sapiens
acccaggctctatcttg

SEQ ID NO: 10060798 - DNA, 22 bp, Homo sapiens
acccaggctggagtgcagtagc

SEQ ID NO: 10060799 - DNA, 22 bp, Homo sapiens
acccaggctgcttctcagtggc

SEQ ID NO: 10060800 - DNA, 22 bp, Homo sapiens
acccaggcgggagtgcagtgtc

SEQ ID NO: 10060801 - DNA, 22 bp, Homo sapiens
acccaggcctgagagacaggag

SEQ ID NO: 10060802 - DNA, 22 bp, Homo sapiens
acccaggctagagtgcagtggt

SEQ ID NO: 10060803 - DNA, 18 bp, Homo sapiens
acccaggctcatggtcct

SEQ ID NO: 10060804 - DNA, 22 bp, Homo sapiens
acccaggctagggtgcagtggc

SEQ ID NO: 10060805 - DNA, 22 bp, Homo sapiens
acccaggccattggcaagagtc

SEQ ID NO: 10060806 - DNA, 22 bp, Homo sapiens
accaggccctccagctgcgtgg

SEQ ID NO: 10060807 - DNA, 22 bp, Homo sapiens
accaggcccgctgctatggtgg

SEQ ID NO: 10060808 - DNA, 19 bp, Homo sapiens
actccagggatgacagaag

SEQ ID NO: 10060809 - DNA, 22 bp, Homo sapiens
actccaggatgtagaatcagag

SEQ ID NO: 10060810 - DNA, 22 bp, Homo sapiens
actccaggaaacttaggggaaa

SEQ ID NO: 10060811 - DNA, 22 bp, Homo sapiens
actggcagcagcagcccttggg

SEQ ID NO: 10060812 - DNA, 22 bp, Homo sapiens
actggcagaactggtgattgtc

SEQ ID NO: 10060813 - DNA, 22 bp, Homo sapiens
actggcagaacgtgatgcgggt

SEQ ID NO: 10060814 - DNA, 22 bp, Homo sapiens
acgtggcggccgccgtgagcgg

SEQ ID NO: 10060815 - DNA, 20 bp, Homo sapiens
acgtggccaccagtggctta

SEQ ID NO: 10060816 - DNA, 22 bp, Homo sapiens
actggcagtagagggagcgcat

SEQ ID NO: 10060817 - DNA, 19 bp, Homo sapiens
actggcagggctgcggtgg

SEQ ID NO: 10060818 - DNA, 22 bp, Homo sapiens
actggcaggctgctggccggcg

SEQ ID NO: 10060819 - DNA, 22 bp, Homo sapiens
actggcagctgtaggatgcatg

SEQ ID NO: 10060820 - DNA, 20 bp, Homo sapiens
actggcagcctgcctgctgt

SEQ ID NO: 10060821 - DNA, 22 bp, Homo sapiens
actggcagccacaactggcagg

SEQ ID NO: 10060822 - DNA, 22 bp, Homo sapiens
aagcctggactatcgcgtgtgc

SEQ ID NO: 10060823 - DNA, 22 bp, Homo sapiens
aaccccgctcaggctgggtgag

SEQ ID NO: 10060824 - DNA, 22 bp, Homo sapiens
aacccaggtctttggcttccag

SEQ ID NO: 10060825 - DNA, 22 bp, Homo sapiens
aacccaggaggcagaggctgca

SEQ ID NO: 10060826 - DNA, 22 bp, Homo sapiens
aacccaggaggcggaggttgtg

SEQ ID NO: 10060827 - DNA, 22 bp, Homo sapiens
aacccaggaggtggaggttgtg

SEQ ID NO: 10060828 - DNA, 22 bp, Homo sapiens
aacccagggtggaggttgcagt

SEQ ID NO: 10060829 - DNA, 22 bp, Homo sapiens
aacccagggtgaggggagtcta

SEQ ID NO: 10060830 - DNA, 22 bp, Homo sapiens
aacccaggagttggaggctgtg

SEQ ID NO: 10060831 - DNA, 22 bp, Homo sapiens
aacccaggagacaggttgcagt

SEQ ID NO: 10060832 - DNA, 22 bp, Homo sapiens
aacccaggagatggaggttgtg

SEQ ID NO: 10060833 - DNA, 22 bp, Homo sapiens
aacccaggagccggaggttgtg

SEQ ID NO: 10060834 - DNA, 22 bp, Homo sapiens
agaccccatacctcagcaggta

SEQ ID NO: 10060835 - DNA, 22 bp, Homo sapiens
aagctcagtgatgcctccaggg

SEQ ID NO: 10060836 - DNA, 22 bp, Homo sapiens
aagctcagcatgtctcctagaa

SEQ ID NO: 10060837 - DNA, 22 bp, Homo sapiens
acccaggagcaggctgggcagt

SEQ ID NO: 10060838 - DNA, 22 bp, Homo sapiens
acccaggaggtgacacagggct

SEQ ID NO: 10060839 - DNA, 22 bp, Homo sapiens
acccaggaggtggaggctgcag

SEQ ID NO: 10060840 - DNA, 22 bp, Homo sapiens
acccaggagctctggggtcctc

SEQ ID NO: 10060841 - DNA, 22 bp, Homo sapiens
acccaggagccgtgagaggtta

SEQ ID NO: 10060842 - DNA, 22 bp, Homo sapiens
acccaggaggcaaggttgcagt

SEQ ID NO: 10060843 - DNA, 22 bp, Homo sapiens
acccaggaggcagaggttgcag

SEQ ID NO: 10060844 - DNA, 22 bp, Homo sapiens
ggaaggtgctccctggacagag

SEQ ID NO: 10060845 - DNA, 22 bp, Homo sapiens
ggagctgcaagtgttgagagct

SEQ ID NO: 10060846 - DNA, 22 bp, Homo sapiens
gctgggctgcgtcggggaagcc

SEQ ID NO: 10060847 - DNA, 22 bp, Homo sapiens
gctgggctccaggccagggtga

SEQ ID NO: 10060848 - DNA, 22 bp, Homo sapiens
ggaactcctgctccaagcagct

SEQ ID NO: 10060849 - DNA, 20 bp, Homo sapiens
ggcagctctagtcgaggccc

SEQ ID NO: 10060850 - DNA, 23 bp, Homo sapiens
ggcagctctcatctgatgactga

SEQ ID NO: 10060851 - DNA, 22 bp, Homo sapiens
ggcagctctgctccacatgagt

SEQ ID NO: 10060852 - DNA, 22 bp, Homo sapiens
ggcagctctgctccttggctcc

SEQ ID NO: 10060853 - DNA, 23 bp, Homo sapiens
ggcacagatgctgagcatgtgca

SEQ ID NO: 10060854 - DNA, 22 bp, Homo sapiens
ggcacagagctttgtcccagtt

SEQ ID NO: 10060855 - DNA, 22 bp, Homo sapiens
ggcacagagctccagccttggc

SEQ ID NO: 10060856 - DNA, 22 bp, Homo sapiens
ggcacagagcccagcttcctag

SEQ ID NO: 10060857 - DNA, 22 bp, Homo sapiens
ggcacagagcaggccactaatc

SEQ ID NO: 10060858 - DNA, 22 bp, Homo sapiens
ggcacagaggttgcctccagat

SEQ ID NO: 10060859 - DNA, 22 bp, Homo sapiens
gggccatgagaggttcatcaac

SEQ ID NO: 10060860 - DNA, 22 bp, Homo sapiens
ggggaccctcaggactgcgtct

SEQ ID NO: 10060861 - DNA, 22 bp, Homo sapiens
ggctgcaggatgcccagccgtg

SEQ ID NO: 10060862 - DNA, 22 bp, Homo sapiens
ggctgcaggaacgacggagggg

SEQ ID NO: 10060863 - DNA, 22 bp, Homo sapiens
ggctgcagagctgggtgggcct

SEQ ID NO: 10060864 - DNA, 19 bp, Homo sapiens
ggctgcagagccccggcgc

SEQ ID NO: 10060865 - DNA, 22 bp, Homo sapiens
ggctgcagaagtacttccggat

SEQ ID NO: 10060866 - DNA, 22 bp, Homo sapiens
ggctgcagagctggtgccctgg

SEQ ID NO: 10060867 - DNA, 22 bp, Homo sapiens
ggctgcagaggcccccagtggg

SEQ ID NO: 10060868 - DNA, 22 bp, Homo sapiens
ggctgcagcggattggggattg

SEQ ID NO: 10060869 - DNA, 22 bp, Homo sapiens
ggcctgggcccactgtcaagag

SEQ ID NO: 10060870 - DNA, 22 bp, Homo sapiens
ggccacctgggatctcatcctg

SEQ ID NO: 10060871 - DNA, 22 bp, Homo sapiens
ggccacctgggttcgactgggc

SEQ ID NO: 10060872 - DNA, 22 bp, Homo sapiens
gtgggctggagcaatgatttca

SEQ ID NO: 10060873 - DNA, 22 bp, Homo sapiens
gtggcagcaaatgcctggacta

SEQ ID NO: 10060874 - DNA, 19 bp, Homo sapiens
gtggcagcagatttggtgt

SEQ ID NO: 10060875 - DNA, 22 bp, Homo sapiens
gtggcagcagaggggtggtatg

SEQ ID NO: 10060876 - DNA, 22 bp, Homo sapiens
gtggcagcaggtactcacgcac

SEQ ID NO: 10060877 - DNA, 22 bp, Homo sapiens
gtggcagcggcccaggccgtct

SEQ ID NO: 10060878 - DNA, 18 bp, Homo sapiens
gtggcagcctttggcttt

SEQ ID NO: 10060879 - DNA, 22 bp, Homo sapiens
gtggcagccgcaggccctgtgt

SEQ ID NO: 10060880 - DNA, 22 bp, Homo sapiens
gtgcgcaccctcccggcatccc

SEQ ID NO: 10060881 - DNA, 22 bp, Homo sapiens
gtggcagctgtgggacactggt

SEQ ID NO: 10060882 - DNA, 22 bp, Homo sapiens
gtggcagctctcttgatttccc

SEQ ID NO: 10060883 - DNA, 22 bp, Homo sapiens
gtggcagctggtatgcagacag

SEQ ID NO: 10060884 - DNA, 22 bp, Homo sapiens
gtcagctgcagtgggcacagcc

SEQ ID NO: 10060885 - DNA, 22 bp, Homo sapiens
gcctggcaggcctcatgagggg

SEQ ID NO: 10060886 - DNA, 22 bp, Homo sapiens
gcctggcaggcctgggccagca

SEQ ID NO: 10060887 - DNA, 22 bp, Homo sapiens
gcctggcaggcctgttggggct

SEQ ID NO: 10060888 - DNA, 19 bp, Homo sapiens
gcctggcagtgtacaaggc

SEQ ID NO: 10060889 - DNA, 22 bp, Homo sapiens
gcctggcagtggggccctggga

SEQ ID NO: 10060890 - DNA, 22 bp, Homo sapiens
gcctggcattacagcactcctg

SEQ ID NO: 10060891 - DNA, 22 bp, Homo sapiens
gcctggcagttgacagtttgct

SEQ ID NO: 10060892 - DNA, 22 bp, Homo sapiens
gcctggcatatagtagttgtgc

SEQ ID NO: 10060893 - DNA, 22 bp, Homo sapiens
gcctggcagggcccggacggca

SEQ ID NO: 10060894 - DNA, 21 bp, Homo sapiens
gcctggcaggtggaagggctc

SEQ ID NO: 10060895 - DNA, 22 bp, Homo sapiens
gcctggcaggggcctgggagtg

SEQ ID NO: 10060896 - DNA, 22 bp, Homo sapiens
gcctggcattggagccggggca

SEQ ID NO: 10060897 - DNA, 22 bp, Homo sapiens
gcctgggaactctgatctcctg

SEQ ID NO: 10060898 - DNA, 22 bp, Homo sapiens
gccgggaccaaggccacggagc

SEQ ID NO: 10060899 - DNA, 22 bp, Homo sapiens
gccctcagctcctggacacatg

SEQ ID NO: 10060900 - DNA, 22 bp, Homo sapiens
gctgctctgggtctgcccagct

SEQ ID NO: 10060901 - DNA, 22 bp, Homo sapiens
gctggagaggatcccaaagcca

SEQ ID NO: 10060902 - DNA, 22 bp, Homo sapiens
gctgctctcagagctcatgctg

SEQ ID NO: 10060903 - DNA, 22 bp, Homo sapiens
gctggagatagtaggatccata

SEQ ID NO: 10060904 - DNA, 20 bp, Homo sapiens
gcacccagcttcttgttcta

SEQ ID NO: 10060905 - DNA, 22 bp, Homo sapiens
gcacccagtttgtctcagggtt

SEQ ID NO: 10060906 - DNA, 22 bp, Homo sapiens
gcacccaggccggcgactgcag

SEQ ID NO: 10060907 - DNA, 22 bp, Homo sapiens
gcacccaggcttgggcagcaac

SEQ ID NO: 10060908 - DNA, 22 bp, Homo sapiens
gcagctctctggcctgccctgg

SEQ ID NO: 10060909 - DNA, 22 bp, Homo sapiens
gcaggctggggtagccccactt

SEQ ID NO: 10060910 - DNA, 21 bp, Homo sapiens
gcaggctggtcaaacctcagt

SEQ ID NO: 10060911 - DNA, 22 bp, Homo sapiens
gatccctgccctcagcctggac

SEQ ID NO: 10060912 - DNA, 22 bp, Homo sapiens
gaggagggttggccttaggtag

SEQ ID NO: 10060913 - DNA, 22 bp, Homo sapiens
gaggagggagaattaggcttaa

SEQ ID NO: 10060914 - DNA, 22 bp, Homo sapiens
gagctggccgcagagagggcag

SEQ ID NO: 10060915 - DNA, 22 bp, Homo sapiens
gaggggcagaggtagagaacaa

SEQ ID NO: 10060916 - DNA, 22 bp, Homo sapiens
gaggctgcccacacctgcgccg

SEQ ID NO: 10060917 - DNA, 22 bp, Homo sapiens
cttgggaggagaacaaagctcc

SEQ ID NO: 10060918 - DNA, 22 bp, Homo sapiens
gacccagggtatccagagctgc

SEQ ID NO: 10060919 - DNA, 22 bp, Homo sapiens
gacccaggctcgtgggacggct

SEQ ID NO: 10060920 - DNA, 22 bp, Homo sapiens
gacccaggggtccatttctcct

SEQ ID NO: 10060921 - DNA, 22 bp, Homo sapiens
gacccaggggcagggagaaagt

SEQ ID NO: 10060922 - DNA, 22 bp, Homo sapiens
gacccaggcccaaggctgccag

SEQ ID NO: 10060923 - DNA, 22 bp, Homo sapiens
gacccaggcaatgaacttactt

SEQ ID NO: 10060924 - DNA, 22 bp, Homo sapiens
gacccaggagagagggttgcat

SEQ ID NO: 10060925 - DNA, 22 bp, Homo sapiens
gacccaggagtgcagagagtgg

SEQ ID NO: 10060926 - DNA, 22 bp, Homo sapiens
gacccaggaagctacttctggt

SEQ ID NO: 10060927 - DNA, 18 bp, Homo sapiens
gacccaggaaagagtcct

SEQ ID NO: 10060928 - DNA, 22 bp, Homo sapiens
gacccagggtggtcacctgaaa

SEQ ID NO: 10060929 - DNA, 22 bp, Homo sapiens
tggcagcttgaatgcagtcttt

SEQ ID NO: 10060930 - DNA, 22 bp, Homo sapiens
tggcagctggtacagtgggtct

SEQ ID NO: 10060931 - DNA, 23 bp, Homo sapiens
tggagctgacagtcagagggagg

SEQ ID NO: 10060932 - DNA, 22 bp, Homo sapiens
cccaggcagcggggtctccttg

SEQ ID NO: 10060933 - DNA, 20 bp, Homo sapiens
cccaggcagagctagcggca

SEQ ID NO: 10060934 - DNA, 22 bp, Homo sapiens
cccaggcagggacgtgctctgg

SEQ ID NO: 10060935 - DNA, 23 bp, Homo sapiens
cccagctggaagttagaggacca

SEQ ID NO: 10060936 - DNA, 23 bp, Homo sapiens
cccagctgagacttcctgaactc

SEQ ID NO: 10060937 - DNA, 22 bp, Homo sapiens
cccagctcttttagcggcatct

SEQ ID NO: 10060938 - DNA, 22 bp, Homo sapiens
tgcctgggcctctgaggaaggc

SEQ ID NO: 10060939 - DNA, 22 bp, Homo sapiens
tgcctgggatctgtgccctttg

SEQ ID NO: 10060940 - DNA, 22 bp, Homo sapiens
tgcctgggagtgaccaagactc

SEQ ID NO: 10060941 - DNA, 22 bp, Homo sapiens
tgcctgggccttcccacctctg

SEQ ID NO: 10060942 - DNA, 22 bp, Homo sapiens
tgcctgggaaccaatcctggct

SEQ ID NO: 10060943 - DNA, 20 bp, Homo sapiens
tgcctgggaaggcgtggagg

SEQ ID NO: 10060944 - DNA, 22 bp, Homo sapiens
tgcctgggactgtactaaattt

SEQ ID NO: 10060945 - DNA, 22 bp, Homo sapiens
tgcctgggacatgctgtggact

SEQ ID NO: 10060946 - DNA, 22 bp, Homo sapiens
tgcctgggactctgttatcttg

SEQ ID NO: 10060947 - DNA, 21 bp, Homo sapiens
ccctcaggaaacagaatgcac

SEQ ID NO: 10060948 - DNA, 22 bp, Homo sapiens
ccccaggcagggcctaacagag

SEQ ID NO: 10060949 - DNA, 17 bp, Homo sapiens
cctgggaggagttatga

SEQ ID NO: 10060950 - DNA, 22 bp, Homo sapiens
cctgggcattctttgagttctc

SEQ ID NO: 10060951 - DNA, 22 bp, Homo sapiens
cctgggcataaatcactccaag

SEQ ID NO: 10060952 - DNA, 22 bp, Homo sapiens
cctgggtgacccgtgagcgtcc

SEQ ID NO: 10060953 - DNA, 22 bp, Homo sapiens
cctgggtgacagagtgagacct

SEQ ID NO: 10060954 - DNA, 22 bp, Homo sapiens
cctgggagagtctgtggtctcc

SEQ ID NO: 10060955 - DNA, 22 bp, Homo sapiens
cctgggagagccatctgtggcc

SEQ ID NO: 10060956 - DNA, 22 bp, Homo sapiens
cctgggagccaagcctctgtgt

SEQ ID NO: 10060957 - DNA, 22 bp, Homo sapiens
cctgggagccgactgactgtgc

SEQ ID NO: 10060958 - DNA, 22 bp, Homo sapiens
cctggctgccgagtgtgcagcg

SEQ ID NO: 10060959 - DNA, 20 bp, Homo sapiens
cctggctgcattcaggacgg

SEQ ID NO: 10060960 - DNA, 22 bp, Homo sapiens
cctggctgcattttgctggatg

SEQ ID NO: 10060961 - DNA, 22 bp, Homo sapiens
tgtctctggcccatgagcagag

SEQ ID NO: 10060962 - DNA, 20 bp, Homo sapiens
cctggcaggcgggttactta

SEQ ID NO: 10060963 - DNA, 22 bp, Homo sapiens
cctggcaggcaagaggaaggga

SEQ ID NO: 10060964 - DNA, 22 bp, Homo sapiens
cctggcaggcccctcctggatt

SEQ ID NO: 10060965 - DNA, 22 bp, Homo sapiens
cctggcagctgtttggcttggc

SEQ ID NO: 10060966 - DNA, 22 bp, Homo sapiens
cctggcaggactgttgtaagaa

SEQ ID NO: 10060967 - DNA, 22 bp, Homo sapiens
cctggcaggtagcattgaggag

SEQ ID NO: 10060968 - DNA, 22 bp, Homo sapiens
cctggcagggctgcagtaatgg

SEQ ID NO: 10060969 - DNA, 22 bp, Homo sapiens
cctggcaggctggggacagtgc

SEQ ID NO: 10060970 - DNA, 22 bp, Homo sapiens
cctggcaggtggaggttgcagt

SEQ ID NO: 10060971 - DNA, 22 bp, Homo sapiens
cctggcaggttacaaccagtta

SEQ ID NO: 10060972 - DNA, 22 bp, Homo sapiens
cctggcaggtggcgccctcggc

SEQ ID NO: 10060973 - DNA, 22 bp, Homo sapiens
cctggcagactgtgagggcagg

SEQ ID NO: 10060974 - DNA, 23 bp, Homo sapiens
cctggcagcaaacgaggaggtta

SEQ ID NO: 10060975 - DNA, 22 bp, Homo sapiens
cctggcagcagcacatgccttc

SEQ ID NO: 10060976 - DNA, 22 bp, Homo sapiens
cctggcagcaggtgggcccgtg

SEQ ID NO: 10060977 - DNA, 18 bp, Homo sapiens
cctggcagccatgcgcgc

SEQ ID NO: 10060978 - DNA, 22 bp, Homo sapiens
cctggcagcattggtagagatt

SEQ ID NO: 10060979 - DNA, 22 bp, Homo sapiens
cctggcagttttgcccaggatt

SEQ ID NO: 10060980 - DNA, 22 bp, Homo sapiens
cctggcagtcaggggagtcctt

SEQ ID NO: 10060981 - DNA, 22 bp, Homo sapiens
cctggcagtggtgaagaagagg

SEQ ID NO: 10060982 - DNA, 22 bp, Homo sapiens
cctggcagttcatcaaatggca

SEQ ID NO: 10060983 - DNA, 22 bp, Homo sapiens
cctggcagaatattaaagtgca

SEQ ID NO: 10060984 - DNA, 22 bp, Homo sapiens
cctggcagacagcactgaagct

SEQ ID NO: 10060985 - DNA, 21 bp, Homo sapiens
cctggcagaagcctgatatgc

SEQ ID NO: 10060986 - DNA, 22 bp, Homo sapiens
cctggcagaaagagttacacct

SEQ ID NO: 10060987 - DNA, 22 bp, Homo sapiens
ctggcactggatcgtgcatatc

SEQ ID NO: 10060988 - DNA, 22 bp, Homo sapiens
ctggcagagtctgctgtctgca

SEQ ID NO: 10060989 - DNA, 22 bp, Homo sapiens
ctggcagatatttgcagacatg

SEQ ID NO: 10060990 - DNA, 22 bp, Homo sapiens
ctggcagattggggtcagcagt

SEQ ID NO: 10060991 - DNA, 22 bp, Homo sapiens
ctggcagcagcttctggatcga

SEQ ID NO: 10060992 - DNA, 22 bp, Homo sapiens
ctggcatggaggactactgagc

SEQ ID NO: 10060993 - DNA, 22 bp, Homo sapiens
ctggcagggtgggctttgcttt

SEQ ID NO: 10060994 - DNA, 22 bp, Homo sapiens
ctggcagcatggagcctgtgct

SEQ ID NO: 10060995 - DNA, 22 bp, Homo sapiens
ctggacagaaagggctgctgtg

SEQ ID NO: 10060996 - DNA, 22 bp, Homo sapiens
ctggacagtgctgcttgagatg

SEQ ID NO: 10060997 - DNA, 21 bp, Homo sapiens
ctggaggcaggtggtgccagg

SEQ ID NO: 10060998 - DNA, 22 bp, Homo sapiens
ctgaggcagaaaaagcaagggt

SEQ ID NO: 10060999 - DNA, 22 bp, Homo sapiens
ctgcagagcatgaggaggtctg

SEQ ID NO: 10061000 - DNA, 22 bp, Homo sapiens
ctgcagacctctgaggtccatg

SEQ ID NO: 10061001 - DNA, 22 bp, Homo sapiens
ctgcagagtggagcctcggctg

SEQ ID NO: 10061002 - DNA, 20 bp, Homo sapiens
ctgaagagtggcctgatctg

SEQ ID NO: 10061003 - DNA, 22 bp, Homo sapiens
ctaggcagggtgctgtgccatg

SEQ ID NO: 10061004 - DNA, 22 bp, Homo sapiens
ctagggagactcgcaggactca

SEQ ID NO: 10061005 - DNA, 22 bp, Homo sapiens
ctctccctatgcctcccaggag

SEQ ID NO: 10061006 - DNA, 19 bp, Homo sapiens
gttggcactgaaaatggct

SEQ ID NO: 10061007 - DNA, 22 bp, Homo sapiens
cagctgcctatgacctagcctc

SEQ ID NO: 10061008 - DNA, 20 bp, Homo sapiens
cagctgcctggctctgggat

SEQ ID NO: 10061009 - DNA, 22 bp, Homo sapiens
cagctgccctgccttgccctta

SEQ ID NO: 10061010 - DNA, 22 bp, Homo sapiens
cagctgccaagaatcttttcta

SEQ ID NO: 10061011 - DNA, 18 bp, Homo sapiens
cagctgcaggctcaggac

SEQ ID NO: 10061012 - DNA, 22 bp, Homo sapiens
cagctgcaggctgtgcaggaag

SEQ ID NO: 10061013 - DNA, 22 bp, Homo sapiens
gtggggcctgtggcttccgtgg

SEQ ID NO: 10061014 - DNA, 22 bp, Homo sapiens
cagctgcctgtattgtcctcat

SEQ ID NO: 10061015 - DNA, 22 bp, Homo sapiens
cagctggcatacctgggcccgg

SEQ ID NO: 10061016 - DNA, 22 bp, Homo sapiens
cagctggggcagccacgtgcgg

SEQ ID NO: 10061017 - DNA, 22 bp, Homo sapiens
cagctctggcgtcagggagcga

SEQ ID NO: 10061018 - DNA, 22 bp, Homo sapiens
cagcccagccgagggcctggct

SEQ ID NO: 10061019 - DNA, 23 bp, Homo sapiens
caggagggaatgaagttagacaa

SEQ ID NO: 10061020 - DNA, 22 bp, Homo sapiens
caggacccatcagccaggcact

SEQ ID NO: 10061021 - DNA, 22 bp, Homo sapiens
caggaagtctttgcccaggcca

SEQ ID NO: 10061022 - DNA, 22 bp, Homo sapiens
caggaagtagagttggccagcc

SEQ ID NO: 10061023 - DNA, 22 bp, Homo sapiens
caggaagtggggtcatggagta

SEQ ID NO: 10061024 - DNA, 22 bp, Homo sapiens
caggaagtggctgggctgggtt

SEQ ID NO: 10061025 - DNA, 22 bp, Homo sapiens
caggcacagctaagactggcca

SEQ ID NO: 10061026 - DNA, 22 bp, Homo sapiens
caggcacatgggagctcatcat

SEQ ID NO: 10061027 - DNA, 22 bp, Homo sapiens
caggcacagtggggtcctctct

SEQ ID NO: 10061028 - DNA, 22 bp, Homo sapiens
caggtctgtattaacagagggt

SEQ ID NO: 10061029 - DNA, 22 bp, Homo sapiens
caggggccggctgtccgtgccc

SEQ ID NO: 10061030 - DNA, 22 bp, Homo sapiens
cagtcctggggaccaggctgag

SEQ ID NO: 10061031 - DNA, 22 bp, Homo sapiens
ccacagctgaaagcagaggctc

SEQ ID NO: 10061032 - DNA, 23 bp, Homo sapiens
ccagctgtgcctggcccaggagc

SEQ ID NO: 10061033 - DNA, 22 bp, Homo sapiens
ccagctggtttatattccccac

SEQ ID NO: 10061034 - DNA, 22 bp, Homo sapiens
ccagcttcatgggcatgcacca

SEQ ID NO: 10061035 - DNA, 22 bp, Homo sapiens
ccaggaagctgtgagattccaa

SEQ ID NO: 10061036 - DNA, 22 bp, Homo sapiens
ccaggaagcggtgagggctgcc

SEQ ID NO: 10061037 - DNA, 22 bp, Homo sapiens
tctgggaggtactgggaggtgt

SEQ ID NO: 10061038 - DNA, 22 bp, Homo sapiens
tctgggagggagcctcagaatc

SEQ ID NO: 10061039 - DNA, 22 bp, Homo sapiens
tctgggagtgaagcaacagatg

SEQ ID NO: 10061040 - DNA, 22 bp, Homo sapiens
tctgggagtgggtccaaggaat

SEQ ID NO: 10061041 - DNA, 22 bp, Homo sapiens
tctgggagtgtgtctggccatc

SEQ ID NO: 10061042 - DNA, 22 bp, Homo sapiens
tctgggaggtggcagggtgcat

SEQ ID NO: 10061043 - DNA, 22 bp, Homo sapiens
tctgggagagagttgataaagg

SEQ ID NO: 10061044 - DNA, 22 bp, Homo sapiens
tctgggagaagctgatgtgaag

SEQ ID NO: 10061045 - DNA, 22 bp, Homo sapiens
tctgggagagctgctgtcagag

SEQ ID NO: 10061046 - DNA, 22 bp, Homo sapiens
tctgggagagcacgtggctgac

SEQ ID NO: 10061047 - DNA, 22 bp, Homo sapiens
tctgggagtttctgtgggagct

SEQ ID NO: 10061048 - DNA, 22 bp, Homo sapiens
tctggcagttgccgcttcagtc

SEQ ID NO: 10061049 - DNA, 22 bp, Homo sapiens
tctggcagtttgagaaaggcta

SEQ ID NO: 10061050 - DNA, 22 bp, Homo sapiens
tctggcagtggatgagggcagc

SEQ ID NO: 10061051 - DNA, 22 bp, Homo sapiens
tctggcagtgatttctgtgatc

SEQ ID NO: 10061052 - DNA, 22 bp, Homo sapiens
tctggcagagatatccatccca

SEQ ID NO: 10061053 - DNA, 22 bp, Homo sapiens
tctggcagaagtgctgtcagta

SEQ ID NO: 10061054 - DNA, 22 bp, Homo sapiens
tctggcagaggaaggaggcctg

SEQ ID NO: 10061055 - DNA, 22 bp, Homo sapiens
tctggcagatcttcccacgttt

SEQ ID NO: 10061056 - DNA, 22 bp, Homo sapiens
tctggcagagtcagtgcacaca

SEQ ID NO: 10061057 - DNA, 22 bp, Homo sapiens
tctggcagggtcagggcccagg

SEQ ID NO: 10061058 - DNA, 22 bp, Homo sapiens
tctggcaggtcaatcattcttt

SEQ ID NO: 10061059 - DNA, 20 bp, Homo sapiens
tctggcaggtgaacgagctg

SEQ ID NO: 10061060 - DNA, 22 bp, Homo sapiens
tctggcagtgaagtcatgaggt

SEQ ID NO: 10061061 - DNA, 22 bp, Homo sapiens
tctgctggccttagcaggtcta

SEQ ID NO: 10061062 - DNA, 22 bp, Homo sapiens
tctgcagaaagtggctcagtgg

SEQ ID NO: 10061063 - DNA, 22 bp, Homo sapiens
tctgcagaagaattaaggacag

SEQ ID NO: 10061064 - DNA, 22 bp, Homo sapiens
tctgcagatttatcagcagctg

SEQ ID NO: 10061065 - DNA, 22 bp, Homo sapiens
tctggggcagttactggggcct

SEQ ID NO: 10061066 - DNA, 22 bp, Homo sapiens
tctctggggatggacctgggag

SEQ ID NO: 10061067 - DNA, 22 bp, Homo sapiens
tctcccaggtgggtgcctggag

SEQ ID NO: 10061068 - DNA, 22 bp, Homo sapiens
tctcccagtgtctggcagtcag

SEQ ID NO: 10061069 - DNA, 22 bp, Homo sapiens
tctcacagttgtccactgaaaa

SEQ ID NO: 10061070 - DNA, 22 bp, Homo sapiens
tctcacagggctaggccctgcc

SEQ ID NO: 10061071 - DNA, 23 bp, Homo sapiens
tctcacagcgatctaggaagagg

SEQ ID NO: 10061072 - DNA, 22 bp, Homo sapiens
tctcacagccatttctccctct

SEQ ID NO: 10061073 - DNA, 22 bp, Homo sapiens
tctcacagcattatccagggca

SEQ ID NO: 10061074 - DNA, 22 bp, Homo sapiens
tctcacagcaggggccaggtct

SEQ ID NO: 10061075 - DNA, 20 bp, Homo sapiens
tctcacagacatcgtctcat

SEQ ID NO: 10061076 - DNA, 22 bp, Homo sapiens
tctcacagatcagcagggggct

SEQ ID NO: 10061077 - DNA, 22 bp, Homo sapiens
tctcaagcttgttggtatgttt

SEQ ID NO: 10061078 - DNA, 22 bp, Homo sapiens
tctaaacattatgatagtagag

SEQ ID NO: 10061079 - DNA, 22 bp, Homo sapiens
tccttgcacattatctgggaaa

SEQ ID NO: 10061080 - DNA, 19 bp, Homo sapiens
tcctggcatttgtaggaaa

SEQ ID NO: 10061081 - DNA, 22 bp, Homo sapiens
tcctggcattgtgcagggtgtg

SEQ ID NO: 10061082 - DNA, 22 bp, Homo sapiens
tcctggcatttacaaacccacc

SEQ ID NO: 10061083 - DNA, 22 bp, Homo sapiens
tcctggcagtgcttgttttgga

SEQ ID NO: 10061084 - DNA, 17 bp, Homo sapiens
tcctggcagtcccctgg

SEQ ID NO: 10061085 - DNA, 22 bp, Homo sapiens
tcctggcacattgcaggggctc

SEQ ID NO: 10061086 - DNA, 18 bp, Homo sapiens
tcctggcagtcagagagg

SEQ ID NO: 10061087 - DNA, 19 bp, Homo sapiens
tcctggcatcttcctccct

SEQ ID NO: 10061088 - DNA, 22 bp, Homo sapiens
tcctggcatccgtgggtctgtg

SEQ ID NO: 10061089 - DNA, 22 bp, Homo sapiens
tcctggcaaagcaagttatgaa

SEQ ID NO: 10061090 - DNA, 20 bp, Homo sapiens
tcctggcaagccgtacctcc

SEQ ID NO: 10061091 - DNA, 22 bp, Homo sapiens
tcctggcaatggcaggttcagg

SEQ ID NO: 10061092 - DNA, 22 bp, Homo sapiens
tcctggcacaaccctttaccag

SEQ ID NO: 10061093 - DNA, 19 bp, Homo sapiens
tcctggcacagtggaacca

SEQ ID NO: 10061094 - DNA, 19 bp, Homo sapiens
tcctggggatgtggtcacc

SEQ ID NO: 10061095 - DNA, 22 bp, Homo sapiens
tcctgggagtaattgagtcatg

SEQ ID NO: 10061096 - DNA, 22 bp, Homo sapiens
tcctgggcggttatgtgatctg

SEQ ID NO: 10061097 - DNA, 22 bp, Homo sapiens
tcctgggcagcgggacgctcag

SEQ ID NO: 10061098 - DNA, 22 bp, Homo sapiens
tcctgggcccaggctgccaggg

SEQ ID NO: 10061099 - DNA, 22 bp, Homo sapiens
tcctgggacaagccgtggaagt

SEQ ID NO: 10061100 - DNA, 22 bp, Homo sapiens
tgaacctggggctgttgctggt

SEQ ID NO: 10061101 - DNA, 22 bp, Homo sapiens
tgacactgccgaaactgtagag

SEQ ID NO: 10061102 - DNA, 21 bp, Homo sapiens
tgactgaggcttcttcacaca

SEQ ID NO: 10061103 - DNA, 22 bp, Homo sapiens
tgagctgccccctggcctgctc

SEQ ID NO: 10061104 - DNA, 19 bp, Homo sapiens
tgagctgctgctgcccatc

SEQ ID NO: 10061105 - DNA, 20 bp, Homo sapiens
tgagcctgctgtaggaggcc

SEQ ID NO: 10061106 - DNA, 22 bp, Homo sapiens
tgagcctggcggaagcagcgtg

SEQ ID NO: 10061107 - DNA, 22 bp, Homo sapiens
tgagcagcttctgtctgaaggc

SEQ ID NO: 10061108 - DNA, 22 bp, Homo sapiens
tgaggctccagccaggccagca

SEQ ID NO: 10061109 - DNA, 22 bp, Homo sapiens
tgaggctcattctgcatgccaa

SEQ ID NO: 10061110 - DNA, 22 bp, Homo sapiens
tgaggctcacgaacagaagact

SEQ ID NO: 10061111 - DNA, 22 bp, Homo sapiens
tgaggctcagagaacagtgact

SEQ ID NO: 10061112 - DNA, 22 bp, Homo sapiens
tgaggctcagaagtgccaagtg

SEQ ID NO: 10061113 - DNA, 22 bp, Homo sapiens
tgaggctcttcctcccctgctc

SEQ ID NO: 10061114 - DNA, 22 bp, Homo sapiens
tgccgcagtgcggggagggccc

SEQ ID NO: 10061115 - DNA, 22 bp, Homo sapiens
tgccctcaagcaacagagagga

SEQ ID NO: 10061116 - DNA, 22 bp, Homo sapiens
tgcatcctcctttgtcctcttg

SEQ ID NO: 10061117 - DNA, 22 bp, Homo sapiens
tgcagggaagtcccagctcctg

SEQ ID NO: 10061118 - DNA, 22 bp, Homo sapiens
tgcagggtggtttgaagggtct

SEQ ID NO: 10061119 - DNA, 22 bp, Homo sapiens
tgcagacaagtcgtgggatctt

SEQ ID NO: 10061120 - DNA, 22 bp, Homo sapiens
tgcagaccacagctaggctgga

SEQ ID NO: 10061121 - DNA, 22 bp, Homo sapiens
tgcagcacatgtctggggctgg

SEQ ID NO: 10061122 - DNA, 22 bp, Homo sapiens
tgcagccttgcctcctcccagc

SEQ ID NO: 10061123 - DNA, 22 bp, Homo sapiens
tgcagctcctctggctgcctga

SEQ ID NO: 10061124 - DNA, 22 bp, Homo sapiens
tgcagctggtatcccatggatt

SEQ ID NO: 10061125 - DNA, 22 bp, Homo sapiens
tgcagcctagacattctggtca

SEQ ID NO: 10061126 - DNA, 20 bp, Homo sapiens
tgcagctggtttcacaggga

SEQ ID NO: 10061127 - DNA, 22 bp, Homo sapiens
tgtgcagcagcagctgtggaga

SEQ ID NO: 10061128 - DNA, 22 bp, Homo sapiens
ttccagctaactcacatccctt

SEQ ID NO: 10061129 - DNA, 22 bp, Homo sapiens
tgggggagatagagtctgatgg

SEQ ID NO: 10061130 - DNA, 22 bp, Homo sapiens
tggggctcctcctggcaggagg

SEQ ID NO: 10061131 - DNA, 22 bp, Homo sapiens
tggggcctgaggtggagctgca

SEQ ID NO: 10061132 - DNA, 22 bp, Homo sapiens
tggggccacactgatctcccag

SEQ ID NO: 10061133 - DNA, 22 bp, Homo sapiens
tgggaggtctcttgcggcctag

SEQ ID NO: 10061134 - DNA, 22 bp, Homo sapiens
tgggcctgggttcctcctgggc

SEQ ID NO: 10061135 - DNA, 20 bp, Homo sapiens
tgggcctgtggcagaagtct

SEQ ID NO: 10061136 - DNA, 21 bp, Homo sapiens
tgggcctgattcccagggtca

SEQ ID NO: 10061137 - DNA, 22 bp, Homo sapiens
tgggcctgagctcaccaggggc

SEQ ID NO: 10061138 - DNA, 22 bp, Homo sapiens
tggttgtggtcctccacatcgc

SEQ ID NO: 10061139 - DNA, 22 bp, Homo sapiens
tggtcctgcagtaatagacatc

SEQ ID NO: 10061140 - DNA, 22 bp, Homo sapiens
tggtcctggagatcaatatgca

SEQ ID NO: 10061141 - DNA, 22 bp, Homo sapiens
tgtccctgcctgcccactctgt

SEQ ID NO: 10061142 - DNA, 22 bp, Homo sapiens
tgtccctggtggaggctggcag

SEQ ID NO: 10061143 - DNA, 22 bp, Homo sapiens
tggaggtggggctcaggaatct

SEQ ID NO: 10061144 - DNA, 22 bp, Homo sapiens
tgcgcctctaatctcgggcgtc

SEQ ID NO: 10061145 - DNA, 22 bp, Homo sapiens
tgcctgggtgtaaagggccaac

SEQ ID NO: 10061146 - DNA, 22 bp, Homo sapiens
tgcctgggttcccaccccaaag

SEQ ID NO: 10061147 - DNA, 22 bp, Homo sapiens
tgcctgggttgactcttagctg

SEQ ID NO: 10061148 - DNA, 22 bp, Homo sapiens
tgcctgggtgccctctgctcct

SEQ ID NO: 10061149 - DNA, 22 bp, Homo sapiens
tgcctgggtccaggccaagcct

SEQ ID NO: 10061150 - DNA, 22 bp, Homo sapiens
tgcctgggtgctggctggtcac

SEQ ID NO: 10061151 - DNA, 22 bp, Homo sapiens
tgcctggggttggcaaactgct

SEQ ID NO: 10061152 - DNA, 22 bp, Homo sapiens
tgcctggggattgctctgggcc

SEQ ID NO: 10061153 - DNA, 22 bp, Homo sapiens
tgcctgggggactaaggccaaa

SEQ ID NO: 10061154 - DNA, 22 bp, Homo sapiens
tgcctgggctcggtagccatcg

SEQ ID NO: 10061155 - DNA, 22 bp, Homo sapiens
tgcctgggctcaccgcctcttt

SEQ ID NO: 10061156 - DNA, 21 bp, Homo sapiens
tgggagagcgttgctgtcctc

SEQ ID NO: 10061157 - DNA, 22 bp, Homo sapiens
tgggagagcttcatgccttcag

SEQ ID NO: 10061158 - DNA, 22 bp, Homo sapiens
tggcagagagagtgcagtcgac

SEQ ID NO: 10061159 - DNA, 22 bp, Homo sapiens
tggcagagaacacggctgatct

SEQ ID NO: 10061160 - DNA, 22 bp, Homo sapiens
tggcagcctcccagctgcattc

SEQ ID NO: 10061161 - DNA, 22 bp, Homo sapiens
tggcagccacatctcgtggatt

SEQ ID NO: 10061162 - DNA, 22 bp, Homo sapiens
tggcagccttctctgagaaggt

SEQ ID NO: 10061163 - DNA, 22 bp, Homo sapiens
tggcagcctggaatctctcagc

SEQ ID NO: 10061164 - DNA, 22 bp, Homo sapiens
tggcaggcagctggcatcctaa

SEQ ID NO: 10061165 - DNA, 22 bp, Homo sapiens
tggcaggcagagagcggccttt

SEQ ID NO: 10061166 - DNA, 22 bp, Homo sapiens
tggcagctgattagatggtgcc

SEQ ID NO: 10061167 - DNA, 22 bp, Homo sapiens
tggcagctgaatggctggatgg

SEQ ID NO: 10061168 - DNA, 22 bp, Homo sapiens
tggcagtcattatcgctgagtc

SEQ ID NO: 10061169 - DNA, 22 bp, Homo sapiens
tggcagtccctctggtagcacc

SEQ ID NO: 10061170 - DNA, 22 bp, Homo sapiens
tggcagtcttgtaggcatctcc

SEQ ID NO: 10061171 - DNA, 20 bp, Homo sapiens
tggccactggccactggagc

SEQ ID NO: 10061172 - DNA, 22 bp, Homo sapiens
tggccactggcttccactgagt

SEQ ID NO: 10061173 - DNA, 22 bp, Homo sapiens
accaggcccaccgcatgctcct

SEQ ID NO: 10061174 - DNA, 22 bp, Homo sapiens
aaggctccctcttctcgagtgt

SEQ ID NO: 10061175 - DNA, 22 bp, Homo sapiens
aaggccttgccgaaggatgcca

SEQ ID NO: 10061176 - DNA, 22 bp, Homo sapiens
aaggcctccgccaatggcagag

SEQ ID NO: 10061177 - DNA, 22 bp, Homo sapiens
aaggcctccctgtgtgcaggtg

SEQ ID NO: 10061178 - DNA, 22 bp, Homo sapiens
aaggcctcaggtgaggctgccc

SEQ ID NO: 10061179 - DNA, 22 bp, Homo sapiens
acagggcagagaggcaggcttg

SEQ ID NO: 10061180 - DNA, 22 bp, Homo sapiens
acagggcagagtgaaatgctat

SEQ ID NO: 10061181 - DNA, 21 bp, Homo sapiens
aatcaggaagtgtgtgtcctg

SEQ ID NO: 10061182 - DNA, 22 bp, Homo sapiens
agaccctgttagttccagtctt

SEQ ID NO: 10061183 - DNA, 22 bp, Homo sapiens
agagcctggacctgagctacaa

SEQ ID NO: 10061184 - DNA, 22 bp, Homo sapiens
agagcctgcatctagcctcaga

SEQ ID NO: 10061185 - DNA, 22 bp, Homo sapiens
agagcctggacttttctgagcc

SEQ ID NO: 10061186 - DNA, 22 bp, Homo sapiens
agagcctggaggttctgctgaa

SEQ ID NO: 10061187 - DNA, 22 bp, Homo sapiens
agagcctggcaaaaggtcctgc

SEQ ID NO: 10061188 - DNA, 22 bp, Homo sapiens
agagccaggcggctgggcacct

SEQ ID NO: 10061189 - DNA, 22 bp, Homo sapiens
agagccaggtgtagtctcggag

SEQ ID NO: 10061190 - DNA, 22 bp, Homo sapiens
agagccaggctctacctgggtt

SEQ ID NO: 10061191 - DNA, 22 bp, Homo sapiens
agaggctctttgagctgggaga

SEQ ID NO: 10061192 - DNA, 22 bp, Homo sapiens
agagggggtgtcagcactgcag

SEQ ID NO: 10061193 - DNA, 22 bp, Homo sapiens
agcagctggggcctgtgacgat

SEQ ID NO: 10061194 - DNA, 22 bp, Homo sapiens
agcagctgggtccggcggagca

SEQ ID NO: 10061195 - DNA, 22 bp, Homo sapiens
agcagctggtaggagtggccac

SEQ ID NO: 10061196 - DNA, 22 bp, Homo sapiens
acacagaagatctcttaatgct

SEQ ID NO: 10061197 - DNA, 22 bp, Homo sapiens
agcagctgtactttcatctgtt

SEQ ID NO: 10061198 - DNA, 22 bp, Homo sapiens
acagagccaaaaggacatagta

SEQ ID NO: 10061199 - DNA, 22 bp, Homo sapiens
agcctctccagagcctggcaga

SEQ ID NO: 10061200 - DNA, 22 bp, Homo sapiens
agcctctcagagtgctgggatt

SEQ ID NO: 10061201 - DNA, 22 bp, Homo sapiens
agcctctctgatgtgacagcta

SEQ ID NO: 10061202 - DNA, 22 bp, Homo sapiens
acagagctaatgttgcataggc

SEQ ID NO: 10061203 - DNA, 22 bp, Homo sapiens
acagagactgggatgcctgcct

SEQ ID NO: 10061204 - DNA, 22 bp, Homo sapiens
agccagggtgagagggctttgt

SEQ ID NO: 10061205 - DNA, 22 bp, Homo sapiens
aacccagggtgaggggagtcta

SEQ ID NO: 10061206 - DNA, 22 bp, Homo sapiens
aacccaggagttggaggctgtg

SEQ ID NO: 10061207 - DNA, 22 bp, Homo sapiens
aacccaggaggcagaggctgca

SEQ ID NO: 10061208 - DNA, 22 bp, Homo sapiens
aaagcctgggttcctcactatc

SEQ ID NO: 10061209 - DNA, 22 bp, Homo sapiens
aagaacagattcagcctgaact

SEQ ID NO: 10061210 - DNA, 20 bp, Homo sapiens
aagaaaacgtcttcagggga

SEQ ID NO: 10061211 - DNA, 22 bp, Homo sapiens
aacatgtatcgctttttaatat

SEQ ID NO: 10061212 - DNA, 22 bp, Homo sapiens
aactaggagtttttcttgagaa

SEQ ID NO: 10061213 - DNA, 22 bp, Homo sapiens
aatggctctgatgttgttgtga

SEQ ID NO: 10061214 - DNA, 22 bp, Homo sapiens
agttgccttcccccagagccaa

SEQ ID NO: 10061215 - DNA, 22 bp, Homo sapiens
atccagagacccaaggacagaa

SEQ ID NO: 10061216 - DNA, 22 bp, Homo sapiens
agggctggtatgtccatgaaag

SEQ ID NO: 10061217 - DNA, 22 bp, Homo sapiens
acctgccttctcaaggacatga

SEQ ID NO: 10061218 - DNA, 21 bp, Homo sapiens
actgcctgtctccatagtcta

SEQ ID NO: 10061219 - DNA, 20 bp, Homo sapiens
accaggcccggtgtctcctc

SEQ ID NO: 10061220 - DNA, 22 bp, Homo sapiens
accaggccctccagctgcgtgg

SEQ ID NO: 10061221 - DNA, 19 bp, Homo sapiens
accaggcctcagaggccct

SEQ ID NO: 10061222 - DNA, 17 bp, Homo sapiens
acccaggctctatcttg

SEQ ID NO: 10061223 - DNA, 22 bp, Homo sapiens
acccaggctgcttctcagtggc

SEQ ID NO: 10061224 - DNA, 22 bp, Homo sapiens
agggcctgggatgtcctcctag

SEQ ID NO: 10061225 - DNA, 22 bp, Homo sapiens
acccgggcaaggattctgagag

SEQ ID NO: 10061226 - DNA, 22 bp, Homo sapiens
agggcctggtgacctgggtcct

SEQ ID NO: 10061227 - DNA, 22 bp, Homo sapiens
aggcctgtttccttgggttgct

SEQ ID NO: 10061228 - DNA, 22 bp, Homo sapiens
aggcctgtttcttgtccagctc

SEQ ID NO: 10061229 - DNA, 22 bp, Homo sapiens
aggcctgtctggggctcagcca

SEQ ID NO: 10061230 - DNA, 22 bp, Homo sapiens
aggcctgttccttcctgggcac

SEQ ID NO: 10061231 - DNA, 22 bp, Homo sapiens
acatggagctcaaacatgagtg

SEQ ID NO: 10061232 - DNA, 22 bp, Homo sapiens
agctgcctgtcctaggccatca

SEQ ID NO: 10061233 - DNA, 18 bp, Homo sapiens
acaggcctcagtcctgca

SEQ ID NO: 10061234 - DNA, 22 bp, Homo sapiens
acaggcctgatgccttggctgg

SEQ ID NO: 10061235 - DNA, 22 bp, Homo sapiens
agcacagagttgctcactgccg

SEQ ID NO: 10061236 - DNA, 22 bp, Homo sapiens
cacaggagccctgaggcctccc

SEQ ID NO: 10061237 - DNA, 22 bp, Homo sapiens
cacaggaggaggccagagcgta

SEQ ID NO: 10061238 - DNA, 22 bp, Homo sapiens
cacaggagctgtggggcagtgt

SEQ ID NO: 10061239 - DNA, 23 bp, Homo sapiens
agcagctgtggtttaccttagta

SEQ ID NO: 10061240 - DNA, 23 bp, Homo sapiens
agcagctgtggagttttgcattt

SEQ ID NO: 10061241 - DNA, 22 bp, Homo sapiens
cacagggcctggggcagctgct

SEQ ID NO: 10061242 - DNA, 22 bp, Homo sapiens
cacagggccttgtgtgactgca

SEQ ID NO: 10061243 - DNA, 22 bp, Homo sapiens
cacagggctttgatggctgagt

SEQ ID NO: 10061244 - DNA, 22 bp, Homo sapiens
cacaggaggcaatggtaagatt

SEQ ID NO: 10061245 - DNA, 22 bp, Homo sapiens
cacaggaggaggtgcccgggcc

SEQ ID NO: 10061246 - DNA, 22 bp, Homo sapiens
cacaggaggttaggaagtggtc

SEQ ID NO: 10061247 - DNA, 22 bp, Homo sapiens
cacaggagggagcgggcagcca

SEQ ID NO: 10061248 - DNA, 22 bp, Homo sapiens
agcagggcctgagtgacctaac

SEQ ID NO: 10061249 - DNA, 22 bp, Homo sapiens
agcaggtgatcgcgtgtgctcc

SEQ ID NO: 10061250 - DNA, 22 bp, Homo sapiens
agctcctcctgagtgtctggga

SEQ ID NO: 10061251 - DNA, 19 bp, Homo sapiens
agctcctcacctctcgcgg

SEQ ID NO: 10061252 - DNA, 20 bp, Homo sapiens
agctcctctgcccattcttc

SEQ ID NO: 10061253 - DNA, 22 bp, Homo sapiens
agctcctctagatctgccactt

SEQ ID NO: 10061254 - DNA, 22 bp, Homo sapiens
agcctccatctcccatctgtga

SEQ ID NO: 10061255 - DNA, 22 bp, Homo sapiens
cagcacaggcccctctctccca

SEQ ID NO: 10061256 - DNA, 22 bp, Homo sapiens
agccctccatctgtgctcaggc

SEQ ID NO: 10061257 - DNA, 22 bp, Homo sapiens
agccctcctcacatcagcgtcc

SEQ ID NO: 10061258 - DNA, 22 bp, Homo sapiens
agccctagagctggaggtcagt

SEQ ID NO: 10061259 - DNA, 23 bp, Homo sapiens
cagagctggctcagagctgcctg

SEQ ID NO: 10061260 - DNA, 23 bp, Homo sapiens
agccaggggatcttgggccctgg

SEQ ID NO: 10061261 - DNA, 22 bp, Homo sapiens
agccaggacatctctagctgct

SEQ ID NO: 10061262 - DNA, 22 bp, Homo sapiens
agccaggattggctgagcctta

SEQ ID NO: 10061263 - DNA, 21 bp, Homo sapiens
agccaggcaagcacccccact

SEQ ID NO: 10061264 - DNA, 22 bp, Homo sapiens
agccaggcagactctctttctt

SEQ ID NO: 10061265 - DNA, 22 bp, Homo sapiens
agccaggcagggctctcgctct

SEQ ID NO: 10061266 - DNA, 22 bp, Homo sapiens
agacacagcaataactactgtt

SEQ ID NO: 10061267 - DNA, 22 bp, Homo sapiens
agaagaggggtgtccctgtggc

SEQ ID NO: 10061268 - DNA, 22 bp, Homo sapiens
cagccaggttcaagtccttata

SEQ ID NO: 10061269 - DNA, 22 bp, Homo sapiens
cagcagctacttggagcagcag

SEQ ID NO: 10061270 - DNA, 19 bp, Homo sapiens
ggtgtgccaaatgggaatg

SEQ ID NO: 10061271 - DNA, 21 bp, Homo sapiens
cagagctctttctgcttgctg

SEQ ID NO: 10061272 - DNA, 22 bp, Homo sapiens
gggcgcagccaatcctggccct

SEQ ID NO: 10061273 - DNA, 19 bp, Homo sapiens
cagagctgctggcctcgtc

SEQ ID NO: 10061274 - DNA, 22 bp, Homo sapiens
cagagccagctgtccttggcat

SEQ ID NO: 10061275 - DNA, 22 bp, Homo sapiens
cagagcccatggcacatgtgga

SEQ ID NO: 10061276 - DNA, 22 bp, Homo sapiens
cagagccctagtcctgatggcc

SEQ ID NO: 10061277 - DNA, 22 bp, Homo sapiens
cagagccctgggcacatggtag

SEQ ID NO: 10061278 - DNA, 22 bp, Homo sapiens
cagagccctcaaggccgatgca

SEQ ID NO: 10061279 - DNA, 22 bp, Homo sapiens
cagaggccacctgtggccactg

SEQ ID NO: 10061280 - DNA, 22 bp, Homo sapiens
ggggaagaatgctctctagaga

SEQ ID NO: 10061281 - DNA, 22 bp, Homo sapiens
cagaggccagtggacaagggcc

SEQ ID NO: 10061282 - DNA, 19 bp, Homo sapiens
cagaggccagaagcacagg

SEQ ID NO: 10061283 - DNA, 21 bp, Homo sapiens
cagaggcctcatgctctgtgc

SEQ ID NO: 10061284 - DNA, 22 bp, Homo sapiens
cagaggcctcacttccagccag

SEQ ID NO: 10061285 - DNA, 22 bp, Homo sapiens
cagaggcctatccagtgtccat

SEQ ID NO: 10061286 - DNA, 22 bp, Homo sapiens
cactggcccagccaggcctgtt

SEQ ID NO: 10061287 - DNA, 22 bp, Homo sapiens
cactggcccataaaggcctggg

SEQ ID NO: 10061288 - DNA, 19 bp, Homo sapiens
gctcctggatgacctgtgg

SEQ ID NO: 10061289 - DNA, 18 bp, Homo sapiens
gctcctggaccaggtcac

SEQ ID NO: 10061290 - DNA, 22 bp, Homo sapiens
cactgcctgctggctgtcactt

SEQ ID NO: 10061291 - DNA, 22 bp, Homo sapiens
caccctggcctcgctctctgca

SEQ ID NO: 10061292 - DNA, 22 bp, Homo sapiens
ggcagctgagatcatgctgttg

SEQ ID NO: 10061293 - DNA, 22 bp, Homo sapiens
ggcagctgaagaggaactttgg

SEQ ID NO: 10061294 - DNA, 21 bp, Homo sapiens
ggcagagctggggcctccagc

SEQ ID NO: 10061295 - DNA, 22 bp, Homo sapiens
ggcagagccttctggagctcgc

SEQ ID NO: 10061296 - DNA, 22 bp, Homo sapiens
ggcagagcttgcagtgagccga

SEQ ID NO: 10061297 - DNA, 22 bp, Homo sapiens
cacagggcaggccccaggcctc

SEQ ID NO: 10061298 - DNA, 22 bp, Homo sapiens
cacagggcagagggtccgtggc

SEQ ID NO: 10061299 - DNA, 22 bp, Homo sapiens
ggaggccttgcctgcaggcaca

SEQ ID NO: 10061300 - DNA, 22 bp, Homo sapiens
gcctgtccttgtgaggtcccag

SEQ ID NO: 10061301 - DNA, 22 bp, Homo sapiens
gcctgtcctatacaggcggctg

SEQ ID NO: 10061302 - DNA, 22 bp, Homo sapiens
gcctgtcctggatgctctgcaa

SEQ ID NO: 10061303 - DNA, 22 bp, Homo sapiens
gcctgtcccgcaccggagcccg

SEQ ID NO: 10061304 - DNA, 22 bp, Homo sapiens
gcctgtccccaggagagtccgg

SEQ ID NO: 10061305 - DNA, 23 bp, Homo sapiens
gcctgggagttgcgatctgcccg

SEQ ID NO: 10061306 - DNA, 22 bp, Homo sapiens
gcctgtccactaaacagccaag

SEQ ID NO: 10061307 - DNA, 22 bp, Homo sapiens
gcctgggagtgcacagtgaggt

SEQ ID NO: 10061308 - DNA, 22 bp, Homo sapiens
gcctgggagggcagcagtgtgg

SEQ ID NO: 10061309 - DNA, 16 bp, Homo sapiens
gcctgggagggaacag

SEQ ID NO: 10061310 - DNA, 22 bp, Homo sapiens
gcctgggagagggatagtgcag

SEQ ID NO: 10061311 - DNA, 22 bp, Homo sapiens
gcctgggagatgcgttgtggcc

SEQ ID NO: 10061312 - DNA, 18 bp, Homo sapiens
gcctgggaggaggaaatg

SEQ ID NO: 10061313 - DNA, 22 bp, Homo sapiens
gcctgggagcacatcggggtcc

SEQ ID NO: 10061314 - DNA, 22 bp, Homo sapiens
gcctgggagattaattaggaag

SEQ ID NO: 10061315 - DNA, 22 bp, Homo sapiens
gcctctctctacccagtatgat

SEQ ID NO: 10061316 - DNA, 22 bp, Homo sapiens
gcctctctgggctgccgaggct

SEQ ID NO: 10061317 - DNA, 18 bp, Homo sapiens
gcctgcctagagcttgcc

SEQ ID NO: 10061318 - DNA, 22 bp, Homo sapiens
gcctccagggtagaggaggaag

SEQ ID NO: 10061319 - DNA, 22 bp, Homo sapiens
gcctctctccttggcttgcagt

SEQ ID NO: 10061320 - DNA, 22 bp, Homo sapiens
gcctctctcgggcttgtagcgg

SEQ ID NO: 10061321 - DNA, 22 bp, Homo sapiens
gcctccagcccacgcaggcctg

SEQ ID NO: 10061322 - DNA, 19 bp, Homo sapiens
gccaggagggctctggctg

SEQ ID NO: 10061323 - DNA, 22 bp, Homo sapiens
gccaggccactcccgggtcctg

SEQ ID NO: 10061324 - DNA, 22 bp, Homo sapiens
gccaggcctgcaagtgctggtg

SEQ ID NO: 10061325 - DNA, 22 bp, Homo sapiens
gccaggccctgggcacttcgtg

SEQ ID NO: 10061326 - DNA, 19 bp, Homo sapiens
gccaggcctggacctgcag

SEQ ID NO: 10061327 - DNA, 22 bp, Homo sapiens
cttgcctgctggagcagggctc

SEQ ID NO: 10061328 - DNA, 22 bp, Homo sapiens
cttgttcatctcattgggactg

SEQ ID NO: 10061329 - DNA, 22 bp, Homo sapiens
atggcagggactgtggcccttg

SEQ ID NO: 10061330 - DNA, 23 bp, Homo sapiens
gagaacagccacagagagctgtg

SEQ ID NO: 10061331 - DNA, 22 bp, Homo sapiens
gagccaggaggcagagactgca

SEQ ID NO: 10061332 - DNA, 22 bp, Homo sapiens
gagccaggaagaaggccttact

SEQ ID NO: 10061333 - DNA, 22 bp, Homo sapiens
gagccaggagatacctaagggg

SEQ ID NO: 10061334 - DNA, 22 bp, Homo sapiens
gagccaggcccgtacttgctgt

SEQ ID NO: 10061335 - DNA, 22 bp, Homo sapiens
gagctgggcctcagaacacagt

SEQ ID NO: 10061336 - DNA, 19 bp, Homo sapiens
ctgtgcaggccgggctgag

SEQ ID NO: 10061337 - DNA, 22 bp, Homo sapiens
ctgtccagtctttagcaagctg

SEQ ID NO: 10061338 - DNA, 22 bp, Homo sapiens
ctgtcctccggccacctacagt

SEQ ID NO: 10061339 - DNA, 21 bp, Homo sapiens
ctgtcctcagatgtggacgag

SEQ ID NO: 10061340 - DNA, 22 bp, Homo sapiens
ctgggaatgagcaggtggctcc

SEQ ID NO: 10061341 - DNA, 22 bp, Homo sapiens
ctgggaaggggaaggtcctctc

SEQ ID NO: 10061342 - DNA, 22 bp, Homo sapiens
ctgggcacacagtgactctgca

SEQ ID NO: 10061343 - DNA, 22 bp, Homo sapiens
ctgggcaccaggcatgacaggg

SEQ ID NO: 10061344 - DNA, 22 bp, Homo sapiens
ctgggagagaagcgaagctggg

SEQ ID NO: 10061345 - DNA, 22 bp, Homo sapiens
ctgggagacaagagagggctga

SEQ ID NO: 10061346 - DNA, 22 bp, Homo sapiens
ctgggcagtggtggcccttccc

SEQ ID NO: 10061347 - DNA, 22 bp, Homo sapiens
ctgcccacagttctctgccatg

SEQ ID NO: 10061348 - DNA, 22 bp, Homo sapiens
ctgcccactatgttgtcatggg

SEQ ID NO: 10061349 - DNA, 22 bp, Homo sapiens
ctgaggcctcactgtagtccct

SEQ ID NO: 10061350 - DNA, 22 bp, Homo sapiens
ctgagggtcaacttgattgtat

SEQ ID NO: 10061351 - DNA, 22 bp, Homo sapiens
ctgaggcctctcccactccagc

SEQ ID NO: 10061352 - DNA, 22 bp, Homo sapiens
ctgaggcctctctccttggctt

SEQ ID NO: 10061353 - DNA, 22 bp, Homo sapiens
ctgaggcctctctcctgggctt

SEQ ID NO: 10061354 - DNA, 22 bp, Homo sapiens
ctgaggcctctttccttggctt

SEQ ID NO: 10061355 - DNA, 22 bp, Homo sapiens
ctgaggcctctgttcaccagaa

SEQ ID NO: 10061356 - DNA, 22 bp, Homo sapiens
ctgccaggcactgggctctgca

SEQ ID NO: 10061357 - DNA, 22 bp, Homo sapiens
ctgccaggactgacgtcttcag

SEQ ID NO: 10061358 - DNA, 22 bp, Homo sapiens
ctgccaggcagcagagggagaa

SEQ ID NO: 10061359 - DNA, 22 bp, Homo sapiens
ctgccaggcctcatcccagcca

SEQ ID NO: 10061360 - DNA, 22 bp, Homo sapiens
cctggctgcttcctctgccatg

SEQ ID NO: 10061361 - DNA, 22 bp, Homo sapiens
cctgggaaggtgaggccctgga

SEQ ID NO: 10061362 - DNA, 22 bp, Homo sapiens
cctggccaatctagggctgtta

SEQ ID NO: 10061363 - DNA, 21 bp, Homo sapiens
cctggccaatctgatagggtt

SEQ ID NO: 10061364 - DNA, 22 bp, Homo sapiens
cctggccagaggcgtgcctgtg

SEQ ID NO: 10061365 - DNA, 19 bp, Homo sapiens
cctggccagacttctgccc

SEQ ID NO: 10061366 - DNA, 22 bp, Homo sapiens
cctggccactcaggtgtggggc

SEQ ID NO: 10061367 - DNA, 22 bp, Homo sapiens
cctggccacagggctctgcatt

SEQ ID NO: 10061368 - DNA, 22 bp, Homo sapiens
cctggccacccagccttggcca

SEQ ID NO: 10061369 - DNA, 22 bp, Homo sapiens
cctggcagcgtgccgagctgcg

SEQ ID NO: 10061370 - DNA, 22 bp, Homo sapiens
cctctctcttgtagtccctgcc

SEQ ID NO: 10061371 - DNA, 22 bp, Homo sapiens
cctgcccaggagtctctctgtg

SEQ ID NO: 10061372 - DNA, 23 bp, Homo sapiens
cctgcccaggaatccggcggcgt

SEQ ID NO: 10061373 - DNA, 22 bp, Homo sapiens
cctgcccagcttcccgagtgca

SEQ ID NO: 10061374 - DNA, 22 bp, Homo sapiens
cctgcccagggtcaccacagag

SEQ ID NO: 10061375 - DNA, 22 bp, Homo sapiens
agggtctgtttaccacctcttt

SEQ ID NO: 10061376 - DNA, 22 bp, Homo sapiens
ctccagagacacttctcatgat

SEQ ID NO: 10061377 - DNA, 22 bp, Homo sapiens
ctccagagagaaaggaggccgc

SEQ ID NO: 10061378 - DNA, 20 bp, Homo sapiens
ctcagtgtggcctgagtgtt

SEQ ID NO: 10061379 - DNA, 22 bp, Homo sapiens
ctcagagggtacaggtgaaccc

SEQ ID NO: 10061380 - DNA, 23 bp, Homo sapiens
ctcagaggtgtttttcacttact

SEQ ID NO: 10061381 - DNA, 22 bp, Homo sapiens
ctcttagtaatgccatgaagca

SEQ ID NO: 10061382 - DNA, 22 bp, Homo sapiens
ctcctgccaccgcggtgtcctg

SEQ ID NO: 10061383 - DNA, 22 bp, Homo sapiens
ctccagagagtccagctctggg

SEQ ID NO: 10061384 - DNA, 22 bp, Homo sapiens
aggaggaattgacacagaagcc

SEQ ID NO: 10061385 - DNA, 22 bp, Homo sapiens
aggagaggctctaactctgtgt

SEQ ID NO: 10061386 - DNA, 22 bp, Homo sapiens
aggagaggcatcaagaaaatcg

SEQ ID NO: 10061387 - DNA, 22 bp, Homo sapiens
cagggccagcgcccaggcccag

SEQ ID NO: 10061388 - DNA, 22 bp, Homo sapiens
cagggccagccatcctgctggg

SEQ ID NO: 10061389 - DNA, 22 bp, Homo sapiens
cagggccagagagggctggctg

SEQ ID NO: 10061390 - DNA, 22 bp, Homo sapiens
cagggccagcccactagcgagg

SEQ ID NO: 10061391 - DNA, 22 bp, Homo sapiens
cagggccagccgcagcatccac

SEQ ID NO: 10061392 - DNA, 22 bp, Homo sapiens
agctgggaagactggaagacag

SEQ ID NO: 10061393 - DNA, 22 bp, Homo sapiens
agctgggaagagttttctgcag

SEQ ID NO: 10061394 - DNA, 22 bp, Homo sapiens
agctgggactcaactgtctggg

SEQ ID NO: 10061395 - DNA, 23 bp, Homo sapiens
agctgggaattttctgaagcttt

SEQ ID NO: 10061396 - DNA, 22 bp, Homo sapiens
agctgggacagacaactatgtt

SEQ ID NO: 10061397 - DNA, 22 bp, Homo sapiens
caggcctcagagagtggcgggg

SEQ ID NO: 10061398 - DNA, 22 bp, Homo sapiens
caggcctcagggctgtccgtag

SEQ ID NO: 10061399 - DNA, 22 bp, Homo sapiens
caggcctcaccagcggagctgc

SEQ ID NO: 10061400 - DNA, 22 bp, Homo sapiens
caggcctcaggggctcaggctg

SEQ ID NO: 10061401 - DNA, 22 bp, Homo sapiens
caggcctcatggtgtgtccttc

SEQ ID NO: 10061402 - DNA, 22 bp, Homo sapiens
caggcctgggcttcggggctga

SEQ ID NO: 10061403 - DNA, 22 bp, Homo sapiens
caggcctcccggtgcacactga

SEQ ID NO: 10061404 - DNA, 21 bp, Homo sapiens
agctgcagcccaaaggcctgt

SEQ ID NO: 10061405 - DNA, 22 bp, Homo sapiens
agggccagctagagccctcgcc

SEQ ID NO: 10061406 - DNA, 22 bp, Homo sapiens
agggccagccgacttccagcct

SEQ ID NO: 10061407 - DNA, 18 bp, Homo sapiens
agggccagctgtgagtag

SEQ ID NO: 10061408 - DNA, 22 bp, Homo sapiens
agggccaggaacacctgaaggg

SEQ ID NO: 10061409 - DNA, 22 bp, Homo sapiens
agggccaggatcacagccaaga

SEQ ID NO: 10061410 - DNA, 22 bp, Homo sapiens
ccctgggattgccttggccttg

SEQ ID NO: 10061411 - DNA, 21 bp, Homo sapiens
ccctgggatgggcttggactt

SEQ ID NO: 10061412 - DNA, 22 bp, Homo sapiens
ccctgggattcaatttcactct

SEQ ID NO: 10061413 - DNA, 22 bp, Homo sapiens
ccctggcccctcactccgaggc

SEQ ID NO: 10061414 - DNA, 22 bp, Homo sapiens
agggcagcagctgtccctgaga

SEQ ID NO: 10061415 - DNA, 22 bp, Homo sapiens
agggcagcctgagtgctggccc

SEQ ID NO: 10061416 - DNA, 22 bp, Homo sapiens
agggccagccccaccctctctg

SEQ ID NO: 10061417 - DNA, 22 bp, Homo sapiens
cctcccagtgcctccagagcag

SEQ ID NO: 10061418 - DNA, 22 bp, Homo sapiens
cctccaggataagtcagggcct

SEQ ID NO: 10061419 - DNA, 22 bp, Homo sapiens
cctccaggccttgcaggttaac

SEQ ID NO: 10061420 - DNA, 22 bp, Homo sapiens
ccccagggactggtttcatgga

SEQ ID NO: 10061421 - DNA, 22 bp, Homo sapiens
aggccgcctggggagaggccct

SEQ ID NO: 10061422 - DNA, 22 bp, Homo sapiens
aggcagtggctgagaccagggg

SEQ ID NO: 10061423 - DNA, 22 bp, Homo sapiens
aggctccacggcaggatgctgt

SEQ ID NO: 10061424 - DNA, 22 bp, Homo sapiens
ccaggcctagcccctgagggta

SEQ ID NO: 10061425 - DNA, 22 bp, Homo sapiens
aggctccattccaggagctaga

SEQ ID NO: 10061426 - DNA, 22 bp, Homo sapiens
ccaggctctatccctccttctt

SEQ ID NO: 10061427 - DNA, 22 bp, Homo sapiens
ccaggctctgagcctcactctt

SEQ ID NO: 10061428 - DNA, 22 bp, Homo sapiens
aggcctctctccttggcttgta

SEQ ID NO: 10061429 - DNA, 22 bp, Homo sapiens
aggcctcctggctccaggcctt

SEQ ID NO: 10061430 - DNA, 22 bp, Homo sapiens
aggcctcctgcagggatgagtg

SEQ ID NO: 10061431 - DNA, 22 bp, Homo sapiens
aggcctccagctgagttttgct

SEQ ID NO: 10061432 - DNA, 17 bp, Homo sapiens
aggcctccctccaggcc

SEQ ID NO: 10061433 - DNA, 22 bp, Homo sapiens
aggcctccagccacatgccagt

SEQ ID NO: 10061434 - DNA, 21 bp, Homo sapiens
tctgtcagaaaagctgaggct

SEQ ID NO: 10061435 - DNA, 22 bp, Homo sapiens
tctgcctgagaagtggggtgcc

SEQ ID NO: 10061436 - DNA, 22 bp, Homo sapiens
tctgcctgaaattcacatgtaa

SEQ ID NO: 10061437 - DNA, 22 bp, Homo sapiens
tctgcctctttcaggcctggca

SEQ ID NO: 10061438 - DNA, 22 bp, Homo sapiens
ccagctggtttatattccccac

SEQ ID NO: 10061439 - DNA, 22 bp, Homo sapiens
ccagctggtgggtctttctctg

SEQ ID NO: 10061440 - DNA, 22 bp, Homo sapiens
ccagctggtgacatccccaacc

SEQ ID NO: 10061441 - DNA, 22 bp, Homo sapiens
ccagccctcactgaggcctctc

SEQ ID NO: 10061442 - DNA, 22 bp, Homo sapiens
tctgaggcagcttgccactcta

SEQ ID NO: 10061443 - DNA, 22 bp, Homo sapiens
tctgaggcccctgggcaggatg

SEQ ID NO: 10061444 - DNA, 22 bp, Homo sapiens
tctgaggccccagccctgcaca

SEQ ID NO: 10061445 - DNA, 22 bp, Homo sapiens
tctgaggcatacccaggccccc

SEQ ID NO: 10061446 - DNA, 22 bp, Homo sapiens
tctgaggcccagttcaactctt

SEQ ID NO: 10061447 - DNA, 19 bp, Homo sapiens
ccagcccatagtccatcac

SEQ ID NO: 10061448 - DNA, 21 bp, Homo sapiens
ccagcccagcctccttctctt

SEQ ID NO: 10061449 - DNA, 22 bp, Homo sapiens
ccagcccaaacaagccgccttc

SEQ ID NO: 10061450 - DNA, 22 bp, Homo sapiens
ccagccagtccagcattggtgt

SEQ ID NO: 10061451 - DNA, 22 bp, Homo sapiens
ccagccagtcccgcatgaccgc

SEQ ID NO: 10061452 - DNA, 22 bp, Homo sapiens
tctctcttgtcaccccatctgc

SEQ ID NO: 10061453 - DNA, 22 bp, Homo sapiens
tctctcttgaagtattagctag

SEQ ID NO: 10061454 - DNA, 22 bp, Homo sapiens
tctctcttcatgcttttagaat

SEQ ID NO: 10061455 - DNA, 22 bp, Homo sapiens
tctctcttctttgttaagaatg

SEQ ID NO: 10061456 - DNA, 23 bp, Homo sapiens
tctctcttagctatgcttatggc

SEQ ID NO: 10061457 - DNA, 22 bp, Homo sapiens
tctctcttcagagataccttgc

SEQ ID NO: 10061458 - DNA, 22 bp, Homo sapiens
tctctcttcaacccttaactag

SEQ ID NO: 10061459 - DNA, 22 bp, Homo sapiens
tctgcctcgctaacagcagcca

SEQ ID NO: 10061460 - DNA, 19 bp, Homo sapiens
tctgcctctggtcaggctc

SEQ ID NO: 10061461 - DNA, 22 bp, Homo sapiens
tctgccagccctgtgagtcttg

SEQ ID NO: 10061462 - DNA, 22 bp, Homo sapiens
tctgccagcaccatgatccttc

SEQ ID NO: 10061463 - DNA, 22 bp, Homo sapiens
ccacagctctagctccctccca

SEQ ID NO: 10061464 - DNA, 23 bp, Homo sapiens
tcctcccaaatttcagcctcatt

SEQ ID NO: 10061465 - DNA, 22 bp, Homo sapiens
tcctcccaacttttccatctca

SEQ ID NO: 10061466 - DNA, 21 bp, Homo sapiens
tcccagggccaggtgccatca

SEQ ID NO: 10061467 - DNA, 22 bp, Homo sapiens
tcccagggcagctgtccagaag

SEQ ID NO: 10061468 - DNA, 22 bp, Homo sapiens
ccagagcttcggggcggctgta

SEQ ID NO: 10061469 - DNA, 22 bp, Homo sapiens
ccagagctgattcctgggactt

SEQ ID NO: 10061470 - DNA, 22 bp, Homo sapiens
ccagagcctgctgagccccatt

SEQ ID NO: 10061471 - DNA, 22 bp, Homo sapiens
ccagagctgatgggcccagggt

SEQ ID NO: 10061472 - DNA, 20 bp, Homo sapiens
ccagacagcacctgcctggt

SEQ ID NO: 10061473 - DNA, 22 bp, Homo sapiens
ccactgccagctttgtcctccc

SEQ ID NO: 10061474 - DNA, 23 bp, Homo sapiens
ccacctggactctgggcaggtgc

SEQ ID NO: 10061475 - DNA, 22 bp, Homo sapiens
cagtcctctcactcaggccttt

SEQ ID NO: 10061476 - DNA, 22 bp, Homo sapiens
cagtgctgagagcctggccagg

SEQ ID NO: 10061477 - DNA, 22 bp, Homo sapiens
cagtgctgcatctccatgccag

SEQ ID NO: 10061478 - DNA, 20 bp, Homo sapiens
tccagcccagcagcctgaca

SEQ ID NO: 10061479 - DNA, 22 bp, Homo sapiens
catgggaataggttgttcttgg

SEQ ID NO: 10061480 - DNA, 22 bp, Homo sapiens
tcagccctgaggacagaggcag

SEQ ID NO: 10061481 - DNA, 22 bp, Homo sapiens
tcagccctagcctcagtccagg

SEQ ID NO: 10061482 - DNA, 22 bp, Homo sapiens
tcagccctgggacccagggatg

SEQ ID NO: 10061483 - DNA, 22 bp, Homo sapiens
tcagggcatggctgcacttggc

SEQ ID NO: 10061484 - DNA, 22 bp, Homo sapiens
tcagggccacgcggaggtgacg

SEQ ID NO: 10061485 - DNA, 22 bp, Homo sapiens
tcagggccacaacaccagagtc

SEQ ID NO: 10061486 - DNA, 22 bp, Homo sapiens
tcagggcattcaagaggcctgg

SEQ ID NO: 10061487 - DNA, 22 bp, Homo sapiens
tcagggcccagagctcaggcaa

SEQ ID NO: 10061488 - DNA, 19 bp, Homo sapiens
tcagggccatgagcgccac

SEQ ID NO: 10061489 - DNA, 22 bp, Homo sapiens
tcagggccatcttttgcctcaa

SEQ ID NO: 10061490 - DNA, 22 bp, Homo sapiens
tcagggccaggactaggatgag

SEQ ID NO: 10061491 - DNA, 22 bp, Homo sapiens
tcagggccctcacttgcatagg

SEQ ID NO: 10061492 - DNA, 22 bp, Homo sapiens
caggcagccaggggacctgtcc

SEQ ID NO: 10061493 - DNA, 22 bp, Homo sapiens
tacagggcatgtgcagacacat

SEQ ID NO: 10061494 - DNA, 22 bp, Homo sapiens
tacagggctgagtgagacatgg

SEQ ID NO: 10061495 - DNA, 22 bp, Homo sapiens
caggaggcccggccacagccca

SEQ ID NO: 10061496 - DNA, 22 bp, Homo sapiens
caggagagatatgagtccccac

SEQ ID NO: 10061497 - DNA, 22 bp, Homo sapiens
caggagccgccaggcacgttgg

SEQ ID NO: 10061498 - DNA, 22 bp, Homo sapiens
cagcccagccgagggcctggct

SEQ ID NO: 10061499 - DNA, 19 bp, Homo sapiens
gtggccagggcaggggctg

SEQ ID NO: 10061500 - DNA, 22 bp, Homo sapiens
gtgtgctgcccaactcgcagat

SEQ ID NO: 10061501 - DNA, 22 bp, Homo sapiens
gtgtctgttatacagaggagac

SEQ ID NO: 10061502 - DNA, 22 bp, Homo sapiens
cagctgcctatgacctagcctc

SEQ ID NO: 10061503 - DNA, 22 bp, Homo sapiens
cagctgcctgcaacacaagctt

SEQ ID NO: 10061504 - DNA, 22 bp, Homo sapiens
cagctgtgatatgcctgcctga

SEQ ID NO: 10061505 - DNA, 22 bp, Homo sapiens
ctctccctcattgggttccatt

SEQ ID NO: 10061506 - DNA, 22 bp, Homo sapiens
ctcctctttacccgcatggtct

SEQ ID NO: 10061507 - DNA, 22 bp, Homo sapiens
ctcctctttagccccagctgga

SEQ ID NO: 10061508 - DNA, 22 bp, Homo sapiens
ctcctcttggaatgcgtggctc

SEQ ID NO: 10061509 - DNA, 22 bp, Homo sapiens
ctccaggcgcttaccaagcgct

SEQ ID NO: 10061510 - DNA, 22 bp, Homo sapiens
ctccagggggcatccacacagc

SEQ ID NO: 10061511 - DNA, 22 bp, Homo sapiens
ctccagggcagcatggcagtgg

SEQ ID NO: 10061512 - DNA, 23 bp, Homo sapiens
cggctgctcggccgagtcctcgg

SEQ ID NO: 10061513 - DNA, 22 bp, Homo sapiens
cggctgggtagaggtgccgggt

SEQ ID NO: 10061514 - DNA, 22 bp, Homo sapiens
cggctggggctgtccccatgac

SEQ ID NO: 10061515 - DNA, 19 bp, Homo sapiens
ctgaaaaacattctcagga

SEQ ID NO: 10061516 - DNA, 22 bp, Homo sapiens
ctctcctctgaagtggtgaccc

SEQ ID NO: 10061517 - DNA, 22 bp, Homo sapiens
ctctggcttagtatgctccaaa

SEQ ID NO: 10061518 - DNA, 22 bp, Homo sapiens
ctgccaggcctggggtgctgtc

SEQ ID NO: 10061519 - DNA, 22 bp, Homo sapiens
ctgccaggcctccgctgtcccc

SEQ ID NO: 10061520 - DNA, 22 bp, Homo sapiens
ctgccaggggcctcacaggcca

SEQ ID NO: 10061521 - DNA, 22 bp, Homo sapiens
ctgccaggctgtcccaggtccg

SEQ ID NO: 10061522 - DNA, 22 bp, Homo sapiens
ctgcctcctggctgatgggtag

SEQ ID NO: 10061523 - DNA, 22 bp, Homo sapiens
ctgcctgcgttgcctcgtgcct

SEQ ID NO: 10061524 - DNA, 22 bp, Homo sapiens
ctgcctccaggctcaccttgac

SEQ ID NO: 10061525 - DNA, 22 bp, Homo sapiens
ctgcctcctcacgtccacagtg

SEQ ID NO: 10061526 - DNA, 22 bp, Homo sapiens
ctgccatgcagttagtccctca

SEQ ID NO: 10061527 - DNA, 22 bp, Homo sapiens
ctgccgtgagctttcgcgagcc

SEQ ID NO: 10061528 - DNA, 22 bp, Homo sapiens
ctgccatctgagggtccagcct

SEQ ID NO: 10061529 - DNA, 22 bp, Homo sapiens
ctgccatccacggcccactcat

SEQ ID NO: 10061530 - DNA, 22 bp, Homo sapiens
ctgccaggtgagctccaggcct

SEQ ID NO: 10061531 - DNA, 22 bp, Homo sapiens
ctgccaggttggcgctcgctct

SEQ ID NO: 10061532 - DNA, 22 bp, Homo sapiens
ctgcagagcatgaggaggtctg

SEQ ID NO: 10061533 - DNA, 22 bp, Homo sapiens
ctggacagaagtggctgggcag

SEQ ID NO: 10061534 - DNA, 22 bp, Homo sapiens
ctggacagaaaccagtcctggg

SEQ ID NO: 10061535 - DNA, 22 bp, Homo sapiens
ctggacagaaaaggccactgga

SEQ ID NO: 10061536 - DNA, 22 bp, Homo sapiens
ctgcctgggccatgcccagtcc

SEQ ID NO: 10061537 - DNA, 22 bp, Homo sapiens
ctgcctggcctgatctccacgc

SEQ ID NO: 10061538 - DNA, 22 bp, Homo sapiens
ctgcctggcccagggatgggcc

SEQ ID NO: 10061539 - DNA, 22 bp, Homo sapiens
ctgcctggatgaatggcgcctt

SEQ ID NO: 10061540 - DNA, 22 bp, Homo sapiens
ctgcctggcatggagaagagaa

SEQ ID NO: 10061541 - DNA, 22 bp, Homo sapiens
ctgcctggccacaacccagggt

SEQ ID NO: 10061542 - DNA, 22 bp, Homo sapiens
ctgcctggaccggcagccctcc

SEQ ID NO: 10061543 - DNA, 22 bp, Homo sapiens
ctgcctggaatgccagcttctc

SEQ ID NO: 10061544 - DNA, 22 bp, Homo sapiens
ctgcctgctctatccaggcctg

SEQ ID NO: 10061545 - DNA, 22 bp, Homo sapiens
ctggcatgccttgggtgcctct

SEQ ID NO: 10061546 - DNA, 22 bp, Homo sapiens
ctggccaggcggcccctgcatg

SEQ ID NO: 10061547 - DNA, 23 bp, Homo sapiens
ctggccaccatctttctggcttc

SEQ ID NO: 10061548 - DNA, 22 bp, Homo sapiens
ctggcagcagcttctggatcga

SEQ ID NO: 10061549 - DNA, 22 bp, Homo sapiens
ctggcaccccacactgtccacg

SEQ ID NO: 10061550 - DNA, 22 bp, Homo sapiens
ctggatcccgtctgagcctcct

SEQ ID NO: 10061551 - DNA, 22 bp, Homo sapiens
ctggatccatcgggtcccgagt

SEQ ID NO: 10061552 - DNA, 22 bp, Homo sapiens
ctggcctgcagatcccagggtc

SEQ ID NO: 10061553 - DNA, 22 bp, Homo sapiens
ctggcctgagcacagcggctgc

SEQ ID NO: 10061554 - DNA, 22 bp, Homo sapiens
ctggccagttgtcctggcttgg

SEQ ID NO: 10061555 - DNA, 22 bp, Homo sapiens
cctggcacgaagggctgaggtt

SEQ ID NO: 10061556 - DNA, 22 bp, Homo sapiens
cctggagacctgatggcagcgg

SEQ ID NO: 10061557 - DNA, 21 bp, Homo sapiens
cctggagacaaagacagggtg

SEQ ID NO: 10061558 - DNA, 22 bp, Homo sapiens
cctgcccacagagagggtgcat

SEQ ID NO: 10061559 - DNA, 22 bp, Homo sapiens
cctgccagtgaagctgacgggc

SEQ ID NO: 10061560 - DNA, 22 bp, Homo sapiens
cctggcagttttgcccaggatt

SEQ ID NO: 10061561 - DNA, 22 bp, Homo sapiens
cctggccaggcatggagtcaca

SEQ ID NO: 10061562 - DNA, 22 bp, Homo sapiens
cctggccagctaattgcccatc

SEQ ID NO: 10061563 - DNA, 22 bp, Homo sapiens
cctggccaggctctcagcactg

SEQ ID NO: 10061564 - DNA, 22 bp, Homo sapiens
cctggccaggctccaagtactg

SEQ ID NO: 10061565 - DNA, 22 bp, Homo sapiens
cctggccagggtctgggctgct

SEQ ID NO: 10061566 - DNA, 22 bp, Homo sapiens
cctggccagtttccaggccctg

SEQ ID NO: 10061567 - DNA, 22 bp, Homo sapiens
cctggccatagggcccaggaaa

SEQ ID NO: 10061568 - DNA, 23 bp, Homo sapiens
cctggcagcaaacgaggaggtta

SEQ ID NO: 10061569 - DNA, 22 bp, Homo sapiens
cctggcctcgtgctcacggctc

SEQ ID NO: 10061570 - DNA, 21 bp, Homo sapiens
cctggctccagaacttccggt

SEQ ID NO: 10061571 - DNA, 22 bp, Homo sapiens
cctggctcgctgacctcagggg

SEQ ID NO: 10061572 - DNA, 22 bp, Homo sapiens
cctggctctctgcagatcctgg

SEQ ID NO: 10061573 - DNA, 22 bp, Homo sapiens
cctggctccctgcacagggctc

SEQ ID NO: 10061574 - DNA, 22 bp, Homo sapiens
cctggctccgtgtcacgtgccc

SEQ ID NO: 10061575 - DNA, 21 bp, Homo sapiens
cctggctgcacagttgctggt

SEQ ID NO: 10061576 - DNA, 19 bp, Homo sapiens
cctggctctgagcccagcc

SEQ ID NO: 10061577 - DNA, 22 bp, Homo sapiens
cctgggccttgacctcgtgggc

SEQ ID NO: 10061578 - DNA, 22 bp, Homo sapiens
cctgggcatcaacaagcagaga

SEQ ID NO: 10061579 - DNA, 21 bp, Homo sapiens
cctgggccaaattccctggac

SEQ ID NO: 10061580 - DNA, 22 bp, Homo sapiens
cctgggccctcaccgccggtgg

SEQ ID NO: 10061581 - DNA, 22 bp, Homo sapiens
cctgggcctcacccagctcttg

SEQ ID NO: 10061582 - DNA, 22 bp, Homo sapiens
cccccaggggctccgcctcgtg

SEQ ID NO: 10061583 - DNA, 22 bp, Homo sapiens
ccccagggaagctttgcttact

SEQ ID NO: 10061584 - DNA, 22 bp, Homo sapiens
tgcctgggactgtactaaattt

SEQ ID NO: 10061585 - DNA, 22 bp, Homo sapiens
tgcctgggactctgttatcttg

SEQ ID NO: 10061586 - DNA, 22 bp, Homo sapiens
tgcctgggagtgaccaagactc

SEQ ID NO: 10061587 - DNA, 22 bp, Homo sapiens
tgcctgggacatgctgtggact

SEQ ID NO: 10061588 - DNA, 20 bp, Homo sapiens
tgcctgggaaggcgtggagg

SEQ ID NO: 10061589 - DNA, 22 bp, Homo sapiens
tgcctgggctcaccgcctcttt

SEQ ID NO: 10061590 - DNA, 22 bp, Homo sapiens
cccaggctcctagaggcccaga

SEQ ID NO: 10061591 - DNA, 22 bp, Homo sapiens
tgcctgggatctgtgccctttg

SEQ ID NO: 10061592 - DNA, 22 bp, Homo sapiens
tgcctgggccttcccacctctg

SEQ ID NO: 10061593 - DNA, 22 bp, Homo sapiens
cccaggctgagttagaggtgtc

SEQ ID NO: 10061594 - DNA, 21 bp, Homo sapiens
tgccaggcctgagctggggtc

SEQ ID NO: 10061595 - DNA, 22 bp, Homo sapiens
tgccaggcgattgctatcagca

SEQ ID NO: 10061596 - DNA, 22 bp, Homo sapiens
cccaggagggtggcctctgccc

SEQ ID NO: 10061597 - DNA, 22 bp, Homo sapiens
ccctccaccaagcagggcgcca

SEQ ID NO: 10061598 - DNA, 22 bp, Homo sapiens
ccctccagggagccatgctggg

SEQ ID NO: 10061599 - DNA, 19 bp, Homo sapiens
ccctggagaataccctgga

SEQ ID NO: 10061600 - DNA, 23 bp, Homo sapiens
ccctggccttggggcacaggctg

SEQ ID NO: 10061601 - DNA, 22 bp, Homo sapiens
cctccctttgttgcaagggaaa

SEQ ID NO: 10061602 - DNA, 22 bp, Homo sapiens
cctcccttggccatagccagcc

SEQ ID NO: 10061603 - DNA, 22 bp, Homo sapiens
cctccaagtttgactcaggaca

SEQ ID NO: 10061604 - DNA, 22 bp, Homo sapiens
cctccagcattactggcccatg

SEQ ID NO: 10061605 - DNA, 22 bp, Homo sapiens
cctccagccttcctgaagagcc

SEQ ID NO: 10061606 - DNA, 22 bp, Homo sapiens
cctctctttcctacaccttgga

SEQ ID NO: 10061607 - DNA, 23 bp, Homo sapiens
cctctctttttaggtggtgtttg

SEQ ID NO: 10061608 - DNA, 22 bp, Homo sapiens
cctctcttggccgcagtcttct

SEQ ID NO: 10061609 - DNA, 22 bp, Homo sapiens
cctctcttggatgtggatgggt

SEQ ID NO: 10061610 - DNA, 16 bp, Homo sapiens
cctctcttattcctcc

SEQ ID NO: 10061611 - DNA, 22 bp, Homo sapiens
tggctgcctcagtgtccctgca

SEQ ID NO: 10061612 - DNA, 22 bp, Homo sapiens
tggctgccctcatgggcctgat

SEQ ID NO: 10061613 - DNA, 22 bp, Homo sapiens
gacccagggtttctgcacaggg

SEQ ID NO: 10061614 - DNA, 22 bp, Homo sapiens
gacccaggagtgcagagagtgg

SEQ ID NO: 10061615 - DNA, 22 bp, Homo sapiens
gacccaggagagagggttgcat

SEQ ID NO: 10061616 - DNA, 22 bp, Homo sapiens
gacccagggtatccagagctgc

SEQ ID NO: 10061617 - DNA, 22 bp, Homo sapiens
gacccagggtggtcacctgaaa

SEQ ID NO: 10061618 - DNA, 22 bp, Homo sapiens
gagagctaggccactggggctt

SEQ ID NO: 10061619 - DNA, 22 bp, Homo sapiens
gagagctccttcaggaagcttc

SEQ ID NO: 10061620 - DNA, 22 bp, Homo sapiens
gagaaaagcgaaggacctggag

SEQ ID NO: 10061621 - DNA, 17 bp, Homo sapiens
gaaggcctgcacaggcc

SEQ ID NO: 10061622 - DNA, 22 bp, Homo sapiens
gaaggcctcactctgcagcata

SEQ ID NO: 10061623 - DNA, 20 bp, Homo sapiens
gacaggagagttaggtaggt

SEQ ID NO: 10061624 - DNA, 22 bp, Homo sapiens
ctggctgggagctcgcctgcgg

SEQ ID NO: 10061625 - DNA, 22 bp, Homo sapiens
gagctgggacatgggtcctctc

SEQ ID NO: 10061626 - DNA, 22 bp, Homo sapiens
gagctggaagtctgtggtcaga

SEQ ID NO: 10061627 - DNA, 22 bp, Homo sapiens
gagctggaggcagtgctgaggt

SEQ ID NO: 10061628 - DNA, 22 bp, Homo sapiens
gagctggaggaccaggactggg

SEQ ID NO: 10061629 - DNA, 22 bp, Homo sapiens
gaggaagggctgcctgccgggc

SEQ ID NO: 10061630 - DNA, 22 bp, Homo sapiens
gaggcctctgtcccaccaggga

SEQ ID NO: 10061631 - DNA, 21 bp, Homo sapiens
gaggcctcagcctcagctcct

SEQ ID NO: 10061632 - DNA, 22 bp, Homo sapiens
gaggcctcaggaatgtcgtgtg

SEQ ID NO: 10061633 - DNA, 22 bp, Homo sapiens
gaggcctcttctttgttaacct

SEQ ID NO: 10061634 - DNA, 18 bp, Homo sapiens
gaggcctgagaaccaggt

SEQ ID NO: 10061635 - DNA, 20 bp, Homo sapiens
gaggcctcagcctcagctcc

SEQ ID NO: 10061636 - DNA, 22 bp, Homo sapiens
gcagggcagccacaggccccct

SEQ ID NO: 10061637 - DNA, 22 bp, Homo sapiens
gcagggcagacctccagcctat

SEQ ID NO: 10061638 - DNA, 22 bp, Homo sapiens
gcagggcacagacagtgccaag

SEQ ID NO: 10061639 - DNA, 18 bp, Homo sapiens
gcagctgacactggagtt

SEQ ID NO: 10061640 - DNA, 22 bp, Homo sapiens
gcagagcctgggggtctgcgga

SEQ ID NO: 10061641 - DNA, 22 bp, Homo sapiens
gcagagcctgtgtctgagcaaa

SEQ ID NO: 10061642 - DNA, 22 bp, Homo sapiens
gcagagccctgggggtatggtg

SEQ ID NO: 10061643 - DNA, 21 bp, Homo sapiens
gcagagcctgaggttcttgag

SEQ ID NO: 10061644 - DNA, 22 bp, Homo sapiens
gcaggagaaatgaagattgggt

SEQ ID NO: 10061645 - DNA, 22 bp, Homo sapiens
gcaggagacaactgtaaggaga

SEQ ID NO: 10061646 - DNA, 22 bp, Homo sapiens
gcaggagctcgtttccaggctg

SEQ ID NO: 10061647 - DNA, 22 bp, Homo sapiens
gcaggagctgctctcctgacga

SEQ ID NO: 10061648 - DNA, 22 bp, Homo sapiens
gcatggcttcggggtgctgcct

SEQ ID NO: 10061649 - DNA, 22 bp, Homo sapiens
gcagagccaggctggggcaggt

SEQ ID NO: 10061650 - DNA, 22 bp, Homo sapiens
gcagagccccattgctggcggg

SEQ ID NO: 10061651 - DNA, 22 bp, Homo sapiens
gcagagccaggagcccaggatc

SEQ ID NO: 10061652 - DNA, 22 bp, Homo sapiens
gcagagccagaatggccaggac

SEQ ID NO: 10061653 - DNA, 22 bp, Homo sapiens
gcagagccaggagagacccttg

SEQ ID NO: 10061654 - DNA, 22 bp, Homo sapiens
gatgtacaaagagaggatttca

SEQ ID NO: 10061655 - DNA, 22 bp, Homo sapiens
gctggcctgaccagccacaggc

SEQ ID NO: 10061656 - DNA, 22 bp, Homo sapiens
gctggcctgagggccgaggctc

SEQ ID NO: 10061657 - DNA, 22 bp, Homo sapiens
gctgggcaccggagagacccca

SEQ ID NO: 10061658 - DNA, 22 bp, Homo sapiens
gctggcctgggcagcctgtcgg

SEQ ID NO: 10061659 - DNA, 22 bp, Homo sapiens
gctggcctgctgggcaccaccg

SEQ ID NO: 10061660 - DNA, 22 bp, Homo sapiens
gctgggagttactgtctccttt

SEQ ID NO: 10061661 - DNA, 22 bp, Homo sapiens
gctgcctgtcccaggatgagga

SEQ ID NO: 10061662 - DNA, 22 bp, Homo sapiens
gctgcctggtttctcagctgca

SEQ ID NO: 10061663 - DNA, 22 bp, Homo sapiens
gctgcctgggctggcattccca

SEQ ID NO: 10061664 - DNA, 22 bp, Homo sapiens
gctgcctggagctcagcctgcc

SEQ ID NO: 10061665 - DNA, 22 bp, Homo sapiens
gctgcctggagaggcagggatg

SEQ ID NO: 10061666 - DNA, 22 bp, Homo sapiens
gctgcctggctgatgaaaattc

SEQ ID NO: 10061667 - DNA, 22 bp, Homo sapiens
gctgcctggatttgcaatcctc

SEQ ID NO: 10061668 - DNA, 22 bp, Homo sapiens
gctgcctggctttagtccactt

SEQ ID NO: 10061669 - DNA, 22 bp, Homo sapiens
gctgcctgggcaggaggcgctg

SEQ ID NO: 10061670 - DNA, 22 bp, Homo sapiens
gctgcctgcttcatgtgggaga

SEQ ID NO: 10061671 - DNA, 22 bp, Homo sapiens
gctgcctggaataacggctggc

SEQ ID NO: 10061672 - DNA, 22 bp, Homo sapiens
gctgcctgctcggctcctggga

SEQ ID NO: 10061673 - DNA, 22 bp, Homo sapiens
gctgcctgctcacccggcctgg

SEQ ID NO: 10061674 - DNA, 22 bp, Homo sapiens
gctgcctgatcatacaccaggg

SEQ ID NO: 10061675 - DNA, 22 bp, Homo sapiens
gctgcctgatgtccagcaggac

SEQ ID NO: 10061676 - DNA, 22 bp, Homo sapiens
gctgcctgaatgaaccttgttc

SEQ ID NO: 10061677 - DNA, 22 bp, Homo sapiens
gctctctttcacagaggtagga

SEQ ID NO: 10061678 - DNA, 22 bp, Homo sapiens
gctctctttgtgccacttaagg

SEQ ID NO: 10061679 - DNA, 22 bp, Homo sapiens
gctctctttccatgtggaggat

SEQ ID NO: 10061680 - DNA, 22 bp, Homo sapiens
gctctctttttccagtggtggt

SEQ ID NO: 10061681 - DNA, 22 bp, Homo sapiens
gctctctttaaactgcatggct

SEQ ID NO: 10061682 - DNA, 21 bp, Homo sapiens
gctctgccacttaccagattt

SEQ ID NO: 10061683 - DNA, 22 bp, Homo sapiens
gctcagagataaaactgatcag

SEQ ID NO: 10061684 - DNA, 22 bp, Homo sapiens
gctcagagatgtctgctgcctt

SEQ ID NO: 10061685 - DNA, 22 bp, Homo sapiens
gctcctggccagcacagggccc

SEQ ID NO: 10061686 - DNA, 22 bp, Homo sapiens
gccctctcttctgcagcctcca

SEQ ID NO: 10061687 - DNA, 22 bp, Homo sapiens
gccctctcggcatagcaggggc

SEQ ID NO: 10061688 - DNA, 22 bp, Homo sapiens
gccgtgtcatctgcgggtggca

SEQ ID NO: 10061689 - DNA, 22 bp, Homo sapiens
gccagtgtgtcatccggctgca

SEQ ID NO: 10061690 - DNA, 22 bp, Homo sapiens
gccaggctgctggctgctgtcc

SEQ ID NO: 10061691 - DNA, 22 bp, Homo sapiens
gccaggctgctccagggaggcc

SEQ ID NO: 10061692 - DNA, 22 bp, Homo sapiens
gccaggctgactcccccggcct

SEQ ID NO: 10061693 - DNA, 22 bp, Homo sapiens
gccatggggctcagctgcacta

SEQ ID NO: 10061694 - DNA, 22 bp, Homo sapiens
gccatgggtctgctggctcagc

SEQ ID NO: 10061695 - DNA, 22 bp, Homo sapiens
gccatggggagggcagcgcctg

SEQ ID NO: 10061696 - DNA, 19 bp, Homo sapiens
gccatgggctggcagcaga

SEQ ID NO: 10061697 - DNA, 23 bp, Homo sapiens
gccatggctgccccacaggcctc

SEQ ID NO: 10061698 - DNA, 22 bp, Homo sapiens
gcctgggaagactaagtgggag

SEQ ID NO: 10061699 - DNA, 22 bp, Homo sapiens
gcctgggaactctgatctcctg

SEQ ID NO: 10061700 - DNA, 23 bp, Homo sapiens
gcctgggactcaggaggagctca

SEQ ID NO: 10061701 - DNA, 22 bp, Homo sapiens
gcctgggacccttagctcttgg

SEQ ID NO: 10061702 - DNA, 21 bp, Homo sapiens
gcctgggaagagaaaggtaag

SEQ ID NO: 10061703 - DNA, 22 bp, Homo sapiens
gcctgggactggatgtgtttgt

SEQ ID NO: 10061704 - DNA, 23 bp, Homo sapiens
gcctgggactggtagtgtgacct

SEQ ID NO: 10061705 - DNA, 22 bp, Homo sapiens
gcctgggactgcagatccccag

SEQ ID NO: 10061706 - DNA, 21 bp, Homo sapiens
gcctgggatagtggcctccgg

SEQ ID NO: 10061707 - DNA, 18 bp, Homo sapiens
gcctgggagaagtttcac

SEQ ID NO: 10061708 - DNA, 22 bp, Homo sapiens
gcctgggagaatgacctccaac

SEQ ID NO: 10061709 - DNA, 22 bp, Homo sapiens
gcctgggatagaggcaatgcat

SEQ ID NO: 10061710 - DNA, 22 bp, Homo sapiens
gcctgggattctcaaaggggtg

SEQ ID NO: 10061711 - DNA, 20 bp, Homo sapiens
gcctgggattatccactggt

SEQ ID NO: 10061712 - DNA, 22 bp, Homo sapiens
gcctgggattcccagaggggca

SEQ ID NO: 10061713 - DNA, 19 bp, Homo sapiens
gcctgggatgggcagaact

SEQ ID NO: 10061714 - DNA, 22 bp, Homo sapiens
gcctgggattgtgtaagtgaat

SEQ ID NO: 10061715 - DNA, 22 bp, Homo sapiens
gcctgtgtggatgcgccggtgc

SEQ ID NO: 10061716 - DNA, 22 bp, Homo sapiens
gcctggccaacgtggtgaaacc

SEQ ID NO: 10061717 - DNA, 17 bp, Homo sapiens
gcctggcccagcctggc

SEQ ID NO: 10061718 - DNA, 22 bp, Homo sapiens
gcctggccgctccgagctccgc

SEQ ID NO: 10061719 - DNA, 22 bp, Homo sapiens
gcctggcccagggctcttgttg

SEQ ID NO: 10061720 - DNA, 22 bp, Homo sapiens
gcctgggaaatggtggggtcag

SEQ ID NO: 10061721 - DNA, 22 bp, Homo sapiens
gcctgggaaagagtagggaaat

SEQ ID NO: 10061722 - DNA, 21 bp, Homo sapiens
gcctgggaaatctgggaagcc

SEQ ID NO: 10061723 - DNA, 22 bp, Homo sapiens
gcctggcctgaactaggaggtg

SEQ ID NO: 10061724 - DNA, 22 bp, Homo sapiens
gcctgccttttggaggcacatt

SEQ ID NO: 10061725 - DNA, 18 bp, Homo sapiens
gcctgccagccgagggac

SEQ ID NO: 10061726 - DNA, 18 bp, Homo sapiens
gcctgccaactcctgatc

SEQ ID NO: 10061727 - DNA, 22 bp, Homo sapiens
gcctgccaaaagaagctgctgg

SEQ ID NO: 10061728 - DNA, 22 bp, Homo sapiens
gcctgcctcaaaatcccagttc

SEQ ID NO: 10061729 - DNA, 20 bp, Homo sapiens
gcctgcctcagctagctgag

SEQ ID NO: 10061730 - DNA, 22 bp, Homo sapiens
gcctgccttcggtgcgcagcgg

SEQ ID NO: 10061731 - DNA, 19 bp, Homo sapiens
gcctgcctgggtttctgag

SEQ ID NO: 10061732 - DNA, 21 bp, Homo sapiens
gcctgcctgcgtgaccctctt

SEQ ID NO: 10061733 - DNA, 22 bp, Homo sapiens
gcctgcctgctgtcatctgcct

SEQ ID NO: 10061734 - DNA, 22 bp, Homo sapiens
gcctgcctgctgtgtgcaagtt

SEQ ID NO: 10061735 - DNA, 22 bp, Homo sapiens
gtccagggggcttaagcaaact

SEQ ID NO: 10061736 - DNA, 20 bp, Homo sapiens
gtctgaggagcagtgggaaa

SEQ ID NO: 10061737 - DNA, 22 bp, Homo sapiens
gtctggcagatcgagcagccca

SEQ ID NO: 10061738 - DNA, 22 bp, Homo sapiens
gtctggcctgccagctctggtg

SEQ ID NO: 10061739 - DNA, 22 bp, Homo sapiens
gtctggcacataagaggagctc

SEQ ID NO: 10061740 - DNA, 22 bp, Homo sapiens
gtggccagctgtcagcaccctt

SEQ ID NO: 10061741 - DNA, 22 bp, Homo sapiens
gtggccagaggtcccatgtgtc

SEQ ID NO: 10061742 - DNA, 22 bp, Homo sapiens
gtgcctggcatgcgccggtgct

SEQ ID NO: 10061743 - DNA, 22 bp, Homo sapiens
gtgcctggcagggtcagctgct

SEQ ID NO: 10061744 - DNA, 22 bp, Homo sapiens
gtgcctggcacacagaaggcaa

SEQ ID NO: 10061745 - DNA, 22 bp, Homo sapiens
gtgcctggagctaatgtgtata

SEQ ID NO: 10061746 - DNA, 20 bp, Homo sapiens
gtgcctggagaagaggctgt

SEQ ID NO: 10061747 - DNA, 22 bp, Homo sapiens
gtgcctggaactgggtaggctg

SEQ ID NO: 10061748 - DNA, 22 bp, Homo sapiens
gtgcctggaccctctttccgga

SEQ ID NO: 10061749 - DNA, 22 bp, Homo sapiens
gtgcctggaatgcgcctcggcg

SEQ ID NO: 10061750 - DNA, 22 bp, Homo sapiens
gtgcctgagccagctgcagctc

SEQ ID NO: 10061751 - DNA, 22 bp, Homo sapiens
gtgaccacttcaaattctagat

SEQ ID NO: 10061752 - DNA, 22 bp, Homo sapiens
gtgacaatattagctcaggggc

SEQ ID NO: 10061753 - DNA, 22 bp, Homo sapiens
gtggcagcaaatgcctggacta

SEQ ID NO: 10061754 - DNA, 22 bp, Homo sapiens
gtgtgtccctcctctcctgagt

SEQ ID NO: 10061755 - DNA, 19 bp, Homo sapiens
gtgtcaggatgtgcagggg

SEQ ID NO: 10061756 - DNA, 22 bp, Homo sapiens
gtgtcaggcagtcagcatggag

SEQ ID NO: 10061757 - DNA, 22 bp, Homo sapiens
ggccagacatatcgctcccaaa

SEQ ID NO: 10061758 - DNA, 22 bp, Homo sapiens
ggccagagaagtcagacccttg

SEQ ID NO: 10061759 - DNA, 22 bp, Homo sapiens
ggccagactgagtgaggtcaag

SEQ ID NO: 10061760 - DNA, 22 bp, Homo sapiens
ggccagagagccgctgttagga

SEQ ID NO: 10061761 - DNA, 22 bp, Homo sapiens
ggccagaggccacagctgtgtc

SEQ ID NO: 10061762 - DNA, 22 bp, Homo sapiens
ggccagaggccatcctcctgct

SEQ ID NO: 10061763 - DNA, 22 bp, Homo sapiens
ggcctgggcctttgtgttttga

SEQ ID NO: 10061764 - DNA, 22 bp, Homo sapiens
ggcctgggcccactgtcaagag

SEQ ID NO: 10061765 - DNA, 22 bp, Homo sapiens
ggccttcctggcggctcagggt

SEQ ID NO: 10061766 - DNA, 22 bp, Homo sapiens
ggctcaggtttccttcccagct

SEQ ID NO: 10061767 - DNA, 22 bp, Homo sapiens
ggctcaggatgagccttctcat

SEQ ID NO: 10061768 - DNA, 22 bp, Homo sapiens
ggctcaggccagaccacgactc

SEQ ID NO: 10061769 - DNA, 22 bp, Homo sapiens
ggctgctctgccttccagctgg

SEQ ID NO: 10061770 - DNA, 22 bp, Homo sapiens
ggcttccagctgggccttggag

SEQ ID NO: 10061771 - DNA, 22 bp, Homo sapiens
ggggaccctcaggactgcgtct

SEQ ID NO: 10061772 - DNA, 22 bp, Homo sapiens
ggggacagtcgatctagtgatt

SEQ ID NO: 10061773 - DNA, 23 bp, Homo sapiens
ggggacagagggcagcccgcatc

SEQ ID NO: 10061774 - DNA, 22 bp, Homo sapiens
gggctagcctcttccctgctcc

SEQ ID NO: 10061775 - DNA, 22 bp, Homo sapiens
gggcccagccctctgctcactg

SEQ ID NO: 10061776 - DNA, 22 bp, Homo sapiens
gggcctgtatgggtctcagata

SEQ ID NO: 10061777 - DNA, 22 bp, Homo sapiens
gggcctgttctgattggcagat

SEQ ID NO: 10061778 - DNA, 22 bp, Homo sapiens
gggcctgtgtgttcaggagcct

SEQ ID NO: 10061779 - DNA, 22 bp, Homo sapiens
gggccaggtggaccccagcctc

SEQ ID NO: 10061780 - DNA, 22 bp, Homo sapiens
gggcagcagagccctgccgagt

SEQ ID NO: 10061781 - DNA, 18 bp, Homo sapiens
gggcagcacagcagcctc

SEQ ID NO: 10061782 - DNA, 22 bp, Homo sapiens
ggcacagagctccagccttggc

SEQ ID NO: 10061783 - DNA, 22 bp, Homo sapiens
ggcagctctgctccttggctcc

SEQ ID NO: 10061784 - DNA, 19 bp, Homo sapiens
ggcagctggacgctgttca

SEQ ID NO: 10061785 - DNA, 22 bp, Homo sapiens
ggcaggcctgagaggcagggct

SEQ ID NO: 10061786 - DNA, 22 bp, Homo sapiens
ggaggtgggagcctccagtggt

SEQ ID NO: 10061787 - DNA, 22 bp, Homo sapiens
ggaggccttgaggccaggagct

SEQ ID NO: 10061788 - DNA, 22 bp, Homo sapiens
ggaagaaatgctcttctatgcg

SEQ ID NO: 10061789 - DNA, 22 bp, Homo sapiens
ggaagaaagcacacaaacttga

SEQ ID NO: 10061790 - DNA, 22 bp, Homo sapiens
tggccagagtccagtgagcctt

SEQ ID NO: 10061791 - DNA, 22 bp, Homo sapiens
tggccagacagagaggctttgt

SEQ ID NO: 10061792 - DNA, 17 bp, Homo sapiens
tggccagagcaggcccc

SEQ ID NO: 10061793 - DNA, 22 bp, Homo sapiens
tggcagggtcttgctgtgttgc

SEQ ID NO: 10061794 - DNA, 22 bp, Homo sapiens
tggcctgagttgtctgcaggcc

SEQ ID NO: 10061795 - DNA, 22 bp, Homo sapiens
tggcctgatacttccagagttc

SEQ ID NO: 10061796 - DNA, 22 bp, Homo sapiens
tggcagggagttcgttcacaac

SEQ ID NO: 10061797 - DNA, 22 bp, Homo sapiens
tggcagggcctgctcatcatcc

SEQ ID NO: 10061798 - DNA, 22 bp, Homo sapiens
tggattcacaccattctcctgc

SEQ ID NO: 10061799 - DNA, 20 bp, Homo sapiens
tggcacagaacccttgccta

SEQ ID NO: 10061800 - DNA, 22 bp, Homo sapiens
tgggagagtctaaaaccgaggt

SEQ ID NO: 10061801 - DNA, 22 bp, Homo sapiens
tgggagaatcttgctctgctac

SEQ ID NO: 10061802 - DNA, 22 bp, Homo sapiens
tgggaacagaggacttgactgt

SEQ ID NO: 10061803 - DNA, 22 bp, Homo sapiens
tggctgggccgggccttgtgcc

SEQ ID NO: 10061804 - DNA, 22 bp, Homo sapiens
tggctgggcccccacctgcctc

SEQ ID NO: 10061805 - DNA, 22 bp, Homo sapiens
tggctggggagccccgactccc

SEQ ID NO: 10061806 - DNA, 19 bp, Homo sapiens
tggctgggcgtgcctccgt

SEQ ID NO: 10061807 - DNA, 22 bp, Homo sapiens
tggctggggccacagttttcct

SEQ ID NO: 10061808 - DNA, 22 bp, Homo sapiens
tggctggggcctgaatcctgca

SEQ ID NO: 10061809 - DNA, 22 bp, Homo sapiens
tggctgggtgctatccagtact

SEQ ID NO: 10061810 - DNA, 19 bp, Homo sapiens
tggctgggtgccaatggcc

SEQ ID NO: 10061811 - DNA, 22 bp, Homo sapiens
tggctgggggtgctatagctgc

SEQ ID NO: 10061812 - DNA, 22 bp, Homo sapiens
tggctcaagtaacaaaaatata

SEQ ID NO: 10061813 - DNA, 22 bp, Homo sapiens
tggcctgggtcacaccagggtc

SEQ ID NO: 10061814 - DNA, 22 bp, Homo sapiens
tgcctgggaaccaatcctggct

SEQ ID NO: 10061815 - DNA, 22 bp, Homo sapiens
tgcctgggctcggtagccatcg

SEQ ID NO: 10061816 - DNA, 22 bp, Homo sapiens
tgcctggggattgctctgggcc

SEQ ID NO: 10061817 - DNA, 22 bp, Homo sapiens
tgcctgggggactaaggccaaa

SEQ ID NO: 10061818 - DNA, 22 bp, Homo sapiens
tgcctgggtccaggccaagcct

SEQ ID NO: 10061819 - DNA, 22 bp, Homo sapiens
tgcctggctctatcagtggtgg

SEQ ID NO: 10061820 - DNA, 22 bp, Homo sapiens
tgcctggctgaggtgacaggtt

SEQ ID NO: 10061821 - DNA, 20 bp, Homo sapiens
tgcctggcctttctctgccc

SEQ ID NO: 10061822 - DNA, 22 bp, Homo sapiens
tgcctggccctgacagccctgg

SEQ ID NO: 10061823 - DNA, 22 bp, Homo sapiens
tgcctgggtgctggctggtcac

SEQ ID NO: 10061824 - DNA, 22 bp, Homo sapiens
tgcctgggtgtaaagggccaac

SEQ ID NO: 10061825 - DNA, 22 bp, Homo sapiens
tgcctgggtgccctctgctcct

SEQ ID NO: 10061826 - DNA, 22 bp, Homo sapiens
tgcctgtgtatttccggcctgc

SEQ ID NO: 10061827 - DNA, 22 bp, Homo sapiens
tgctccaccctcacactcttcc

SEQ ID NO: 10061828 - DNA, 22 bp, Homo sapiens
tgctgagggagcatcaaagaaa

SEQ ID NO: 10061829 - DNA, 22 bp, Homo sapiens
tgctgaggcatttggacagagt

SEQ ID NO: 10061830 - DNA, 22 bp, Homo sapiens
tgctctggtcctccctcggcgc

SEQ ID NO: 10061831 - DNA, 22 bp, Homo sapiens
tgcttccctcacttcacctggc

SEQ ID NO: 10061832 - DNA, 23 bp, Homo sapiens
tgctgtccaacagactggccatg

SEQ ID NO: 10061833 - DNA, 22 bp, Homo sapiens
tgctgggcttgaaagctgctaa

SEQ ID NO: 10061834 - DNA, 22 bp, Homo sapiens
tgctgggcttcacccccacagt

SEQ ID NO: 10061835 - DNA, 22 bp, Homo sapiens
tgctgggctgttcctgtccatg

SEQ ID NO: 10061836 - DNA, 22 bp, Homo sapiens
tgctgcctaataagtcgagggt

SEQ ID NO: 10061837 - DNA, 22 bp, Homo sapiens
tgctgccagccaggccatggag

SEQ ID NO: 10061838 - DNA, 19 bp, Homo sapiens
tggagaggaaatgctgctc

SEQ ID NO: 10061839 - DNA, 22 bp, Homo sapiens
tggagagctatttggacctcca

SEQ ID NO: 10061840 - DNA, 22 bp, Homo sapiens
tggagagcgtgcttagcactct

SEQ ID NO: 10061841 - DNA, 22 bp, Homo sapiens
tggagagcccgagacatcctgt

SEQ ID NO: 10061842 - DNA, 22 bp, Homo sapiens
tggagaggagcaccatggccat

SEQ ID NO: 10061843 - DNA, 22 bp, Homo sapiens
tggagccagagcgcagcctggg

SEQ ID NO: 10061844 - DNA, 22 bp, Homo sapiens
tggaccacatagtgaggccccc

SEQ ID NO: 10061845 - DNA, 22 bp, Homo sapiens
tgtccaggtcagcagcagggac

SEQ ID NO: 10061846 - DNA, 22 bp, Homo sapiens
tgtccagggatggggtcaggga

SEQ ID NO: 10061847 - DNA, 22 bp, Homo sapiens
tgtcctggtgctccaggtggct

SEQ ID NO: 10061848 - DNA, 22 bp, Homo sapiens
tgtcctgggtcaaccaggtcga

SEQ ID NO: 10061849 - DNA, 22 bp, Homo sapiens
tgtcctgggaactcacagtcca

SEQ ID NO: 10061850 - DNA, 22 bp, Homo sapiens
tgtcctgggaggcggggtccag

SEQ ID NO: 10061851 - DNA, 22 bp, Homo sapiens
tgtcctgggtcaaatcctggtc

SEQ ID NO: 10061852 - DNA, 22 bp, Homo sapiens
tgtcctggggacaagaggccct

SEQ ID NO: 10061853 - DNA, 22 bp, Homo sapiens
tgggcctctgccacgctccccc

SEQ ID NO: 10061854 - DNA, 22 bp, Homo sapiens
tgggccagtccagccccaggga

SEQ ID NO: 10061855 - DNA, 22 bp, Homo sapiens
tgggccagtagctactcgcaag

SEQ ID NO: 10061856 - DNA, 22 bp, Homo sapiens
tgggcctcatgcccagccaccc

SEQ ID NO: 10061857 - DNA, 22 bp, Homo sapiens
tgggccagttggtgactacaaa

SEQ ID NO: 10061858 - DNA, 22 bp, Homo sapiens
tgggccagttatttcacctctg

SEQ ID NO: 10061859 - DNA, 22 bp, Homo sapiens
tgggatggcatcctgggccttg

SEQ ID NO: 10061860 - DNA, 22 bp, Homo sapiens
tgggcacagaatagatggccca

SEQ ID NO: 10061861 - DNA, 22 bp, Homo sapiens
tgggccagctgaagtgccgccc

SEQ ID NO: 10061862 - DNA, 22 bp, Homo sapiens
tgggccagctccctgcccctgg

SEQ ID NO: 10061863 - DNA, 22 bp, Homo sapiens
tgggcagcaaagactgtgtgct

SEQ ID NO: 10061864 - DNA, 22 bp, Homo sapiens
tgggcagcatcctccacagtca

SEQ ID NO: 10061865 - DNA, 23 bp, Homo sapiens
tgggcagcttctgcatgcccacc

SEQ ID NO: 10061866 - DNA, 22 bp, Homo sapiens
tgggcagccatcccagcctctc

SEQ ID NO: 10061867 - DNA, 22 bp, Homo sapiens
tgggctggctgaggcattcact

SEQ ID NO: 10061868 - DNA, 22 bp, Homo sapiens
tgggctggtgagggatcattta

SEQ ID NO: 10061869 - DNA, 22 bp, Homo sapiens
tgggctggcgtggagagtttag

SEQ ID NO: 10061870 - DNA, 22 bp, Homo sapiens
tgggctggctgaacttcaacct

SEQ ID NO: 10061871 - DNA, 23 bp, Homo sapiens
ttccagagtccacatctgccacc

SEQ ID NO: 10061872 - DNA, 22 bp, Homo sapiens
ttccagagtcagccactgggag

SEQ ID NO: 10061873 - DNA, 22 bp, Homo sapiens
ttccagaggcttcagggaagaa

SEQ ID NO: 10061874 - DNA, 22 bp, Homo sapiens
ttccagaggggaggtggcagcc

SEQ ID NO: 10061875 - DNA, 22 bp, Homo sapiens
ttccagaggttctcagccctgt

SEQ ID NO: 10061876 - DNA, 22 bp, Homo sapiens
ttccagaggctctaggggagaa

SEQ ID NO: 10061877 - DNA, 22 bp, Homo sapiens
tgtgcctgtcaccctcagagag

SEQ ID NO: 10061878 - DNA, 22 bp, Homo sapiens
tgtgcctgagtctcggcccacc

SEQ ID NO: 10061879 - DNA, 22 bp, Homo sapiens
tgtgcctggatctctgtgacaa

SEQ ID NO: 10061880 - DNA, 20 bp, Homo sapiens
tgtgagagggtggcttgccc

SEQ ID NO: 10061881 - DNA, 22 bp, Homo sapiens
tgtgtcagaaggcaatggggat

SEQ ID NO: 10061882 - DNA, 22 bp, Homo sapiens
tgcagagggacagccacagctc

SEQ ID NO: 10061883 - DNA, 21 bp, Homo sapiens
tgcacagggcccaggagagcc

SEQ ID NO: 10061884 - DNA, 22 bp, Homo sapiens
tgcacagggagggggccagctc

SEQ ID NO: 10061885 - DNA, 19 bp, Homo sapiens
tgcagggctgcgcctgggg

SEQ ID NO: 10061886 - DNA, 22 bp, Homo sapiens
tgcagggcttcctcttggagtt

SEQ ID NO: 10061887 - DNA, 20 bp, Homo sapiens
tgcagggctctgcttctctc

SEQ ID NO: 10061888 - DNA, 20 bp, Homo sapiens
tgcagggctgcctcccagct

SEQ ID NO: 10061889 - DNA, 22 bp, Homo sapiens
tgcagggcacggtgcgcgtggg

SEQ ID NO: 10061890 - DNA, 22 bp, Homo sapiens
tgcagggcagatatgactgtag

SEQ ID NO: 10061891 - DNA, 23 bp, Homo sapiens
tgcagggcaagttagagacccca

SEQ ID NO: 10061892 - DNA, 22 bp, Homo sapiens
tgcagggcccctctgcatgagt

SEQ ID NO: 10061893 - DNA, 22 bp, Homo sapiens
tgcagggccctcattcctgtcc

SEQ ID NO: 10061894 - DNA, 22 bp, Homo sapiens
tgcagggctataactccattct

SEQ ID NO: 10061895 - DNA, 22 bp, Homo sapiens
tgcagggcatagggtccagttt

SEQ ID NO: 10061896 - DNA, 22 bp, Homo sapiens
tgcagggccatggtggcggctg

SEQ ID NO: 10061897 - DNA, 22 bp, Homo sapiens
tgcctaggctggagtgtagtgg

SEQ ID NO: 10061898 - DNA, 20 bp, Homo sapiens
tgcctgacttcagcatcagt

SEQ ID NO: 10061899 - DNA, 22 bp, Homo sapiens
tgcctgactgctgccaccacta

SEQ ID NO: 10061900 - DNA, 22 bp, Homo sapiens
tgcctgaggagtcagggcaggt

SEQ ID NO: 10061901 - DNA, 22 bp, Homo sapiens
tgcctcagagttgtccctacca

SEQ ID NO: 10061902 - DNA, 22 bp, Homo sapiens
tgcctccattcctgggtcattg

SEQ ID NO: 10061903 - DNA, 22 bp, Homo sapiens
tgcctccctctctgccactgga

SEQ ID NO: 10061904 - DNA, 22 bp, Homo sapiens
tgcctccctggcaagtctctcc

SEQ ID NO: 10061905 - DNA, 22 bp, Homo sapiens
tgcctctctaacccatgcccaa

SEQ ID NO: 10061906 - DNA, 20 bp, Homo sapiens
tgcctgcccaggtcctgcac

SEQ ID NO: 10061907 - DNA, 22 bp, Homo sapiens
tgcctgccccacaaggggttgc

SEQ ID NO: 10061908 - DNA, 22 bp, Homo sapiens
tgcctgcccacgactacagcag

SEQ ID NO: 10061909 - DNA, 22 bp, Homo sapiens
tgcctgccaggcaacctgggag

SEQ ID NO: 10061910 - DNA, 22 bp, Homo sapiens
tgcctgccacgcttgctaccac

SEQ ID NO: 10061911 - DNA, 22 bp, Homo sapiens
tgcctggcaagaggggctggct

SEQ ID NO: 10061912 - DNA, 22 bp, Homo sapiens
tgcctggcaatgccagaagcca

SEQ ID NO: 10061913 - DNA, 22 bp, Homo sapiens
tgcctggcatctagccctggga

SEQ ID NO: 10061914 - DNA, 22 bp, Homo sapiens
tgcctggcactcctggagctca

SEQ ID NO: 10061915 - DNA, 22 bp, Homo sapiens
tgcctggcaccccagtctgcac

SEQ ID NO: 10061916 - DNA, 22 bp, Homo sapiens
tgcctggcacagagcaggtggc

SEQ ID NO: 10061917 - DNA, 19 bp, Homo sapiens
tgcctggcaccagctccac

SEQ ID NO: 10061918 - DNA, 22 bp, Homo sapiens
tgcccaggctggagtgcagagg

SEQ ID NO: 10061919 - DNA, 22 bp, Homo sapiens
tgcccaggctggagtgcagtgg

SEQ ID NO: 10061920 - DNA, 22 bp, Homo sapiens
tgcccagggtggagtgcagcgg

SEQ ID NO: 10061921 - DNA, 22 bp, Homo sapiens
tgcccagggtggagtgcagtgg

SEQ ID NO: 10061922 - DNA, 22 bp, Homo sapiens
tgccatggaatcacctccagct

SEQ ID NO: 10061923 - DNA, 22 bp, Homo sapiens
tgccatggaagtggccagacct

SEQ ID NO: 10061924 - DNA, 22 bp, Homo sapiens
tgccagggtgtcaggagagcta

SEQ ID NO: 10061925 - DNA, 22 bp, Homo sapiens
tgccagggtcctgagggccttg

SEQ ID NO: 10061926 - DNA, 22 bp, Homo sapiens
tgccaggggacctagggatgtc

SEQ ID NO: 10061927 - DNA, 22 bp, Homo sapiens
tgccagggccatagggagtcta

SEQ ID NO: 10061928 - DNA, 22 bp, Homo sapiens
tgccaggctccggaacgacagt

SEQ ID NO: 10061929 - DNA, 22 bp, Homo sapiens
tgccaggctgaacagggtctta

SEQ ID NO: 10061930 - DNA, 20 bp, Homo sapiens
tgccaggctgcacgcctgcc

SEQ ID NO: 10061931 - DNA, 22 bp, Homo sapiens
tgccaggctgtcaattcaccca

SEQ ID NO: 10061932 - DNA, 22 bp, Homo sapiens
tgccaggctgtcctgggcctgg

SEQ ID NO: 10061933 - DNA, 22 bp, Homo sapiens
tgccaggctgccctccagtctg

SEQ ID NO: 10061934 - DNA, 21 bp, Homo sapiens
tgccagggatttacagagcct

SEQ ID NO: 10061935 - DNA, 20 bp, Homo sapiens
tgccagggccagcagaggct

SEQ ID NO: 10061936 - DNA, 22 bp, Homo sapiens
tgccaggcttagagcaggggct

SEQ ID NO: 10061937 - DNA, 22 bp, Homo sapiens
tgccaggctttggtcaaaggct

SEQ ID NO: 10061938 - DNA, 22 bp, Homo sapiens
tgccaggctcaggatgtccctg

SEQ ID NO: 10061939 - DNA, 22 bp, Homo sapiens
tgccaggccctcccacagatta

SEQ ID NO: 10061940 - DNA, 22 bp, Homo sapiens
tgccaggcccagctccagagct

SEQ ID NO: 10061941 - DNA, 22 bp, Homo sapiens
tgccaggccacgtagcttcaag

SEQ ID NO: 10061942 - DNA, 22 bp, Homo sapiens
tgccaggccaatgaaggcaggg

SEQ ID NO: 10061943 - DNA, 22 bp, Homo sapiens
tgccaggccaattctatttgac

SEQ ID NO: 10061944 - DNA, 20 bp, Homo sapiens
tgccaggcacggagtgcatg

SEQ ID NO: 10061945 - DNA, 22 bp, Homo sapiens
tgccaggcaggaccctagaacc

SEQ ID NO: 10061946 - DNA, 22 bp, Homo sapiens
tgccaggcacgtgagagtggcc

SEQ ID NO: 10061947 - DNA, 22 bp, Homo sapiens
tgccaggcatgtagtagacttg

SEQ ID NO: 10061948 - DNA, 22 bp, Homo sapiens
tgccaggcagtgtcagattgag

SEQ ID NO: 10061949 - DNA, 22 bp, Homo sapiens
tgccaggcatatggcctctttg

SEQ ID NO: 10061950 - DNA, 22 bp, Homo sapiens
tgaggcaggagaatggcgggaa

SEQ ID NO: 10061951 - DNA, 22 bp, Homo sapiens
tgaggcaggaggattgcaggat

SEQ ID NO: 10061952 - DNA, 23 bp, Homo sapiens
tgaggcaggcggatcacgaggtc

SEQ ID NO: 10061953 - DNA, 22 bp, Homo sapiens
tgaggcaggagttcaggctgcg

SEQ ID NO: 10061954 - DNA, 22 bp, Homo sapiens
tgaggcctacccccctgtgttt

SEQ ID NO: 10061955 - DNA, 22 bp, Homo sapiens
tgaggcctctgtgccatccagg

SEQ ID NO: 10061956 - DNA, 17 bp, Homo sapiens
tgaggcctgcatcagtg

SEQ ID NO: 10061957 - DNA, 22 bp, Homo sapiens
tgaggcctgacagaccaagcct

SEQ ID NO: 10061958 - DNA, 22 bp, Homo sapiens
tgagccagataagggctcacgc

SEQ ID NO: 10061959 - DNA, 22 bp, Homo sapiens
tgagccaggcactgctcctgga

SEQ ID NO: 10061960 - DNA, 20 bp, Homo sapiens
tgagcctgctgtaggaggcc

SEQ ID NO: 10061961 - DNA, 22 bp, Homo sapiens
tgagaacattcctcttcctggc

SEQ ID NO: 10061962 - DNA, 22 bp, Homo sapiens
tgagagcctgtgttcaaatgcc

SEQ ID NO: 10061963 - DNA, 21 bp, Homo sapiens
tgagagcctccaaccggctac

SEQ ID NO: 10061964 - DNA, 22 bp, Homo sapiens
tgagagccagaagggcctgagg

SEQ ID NO: 10061965 - DNA, 23 bp, Homo sapiens
tgagagcctggcagcctgggttc

SEQ ID NO: 10061966 - DNA, 22 bp, Homo sapiens
tcctgggacaccccaatatgag

SEQ ID NO: 10061967 - DNA, 22 bp, Homo sapiens
tcctgggacaagccgtggaagt

SEQ ID NO: 10061968 - DNA, 22 bp, Homo sapiens
tcctgggaccaggcacctactg

SEQ ID NO: 10061969 - DNA, 22 bp, Homo sapiens
tcctgggaagttgcatcaccgt

SEQ ID NO: 10061970 - DNA, 22 bp, Homo sapiens
tcctgggaagtggctggctgag

SEQ ID NO: 10061971 - DNA, 22 bp, Homo sapiens
tcctgggaagcgccggcctgcg

SEQ ID NO: 10061972 - DNA, 21 bp, Homo sapiens
tcctgggaagcactggggtgg

SEQ ID NO: 10061973 - DNA, 22 bp, Homo sapiens
tcctgggaggctgtgcctggct

SEQ ID NO: 10061974 - DNA, 22 bp, Homo sapiens
tcctgggaggcggaggttgcag

SEQ ID NO: 10061975 - DNA, 22 bp, Homo sapiens
tcctgggaggcaggaccccttt

SEQ ID NO: 10061976 - DNA, 22 bp, Homo sapiens
tcctgggactcaacttagaagg

SEQ ID NO: 10061977 - DNA, 22 bp, Homo sapiens
tcctgggactctgcctcaggct

SEQ ID NO: 10061978 - DNA, 22 bp, Homo sapiens
tcctgggaccctgggtgcagag

SEQ ID NO: 10061979 - DNA, 22 bp, Homo sapiens
tcctgggaccgagggaagagct

SEQ ID NO: 10061980 - DNA, 22 bp, Homo sapiens
tcctgggaactcggaaagctct

SEQ ID NO: 10061981 - DNA, 18 bp, Homo sapiens
tcctgggaacttgctagc

SEQ ID NO: 10061982 - DNA, 22 bp, Homo sapiens
tcctgggaagactgtgaggaca

SEQ ID NO: 10061983 - DNA, 22 bp, Homo sapiens
tcctgggaagagacctgagcat

SEQ ID NO: 10061984 - DNA, 18 bp, Homo sapiens
tcctgggaaaggcataca

SEQ ID NO: 10061985 - DNA, 19 bp, Homo sapiens
tcctgggctgggccaggtc

SEQ ID NO: 10061986 - DNA, 22 bp, Homo sapiens
tcctgggagtggccatgtaatg

SEQ ID NO: 10061987 - DNA, 21 bp, Homo sapiens
tcctgggagtctgagatcctg

SEQ ID NO: 10061988 - DNA, 22 bp, Homo sapiens
tcctgggagtaaaagctgccct

SEQ ID NO: 10061989 - DNA, 22 bp, Homo sapiens
tcctgggaggtaaaccagcatc

SEQ ID NO: 10061990 - DNA, 22 bp, Homo sapiens
tcctgggagtaattgagtcatg

SEQ ID NO: 10061991 - DNA, 22 bp, Homo sapiens
tcctgggatactaagaaatttt

SEQ ID NO: 10061992 - DNA, 22 bp, Homo sapiens
tcctgggatcaagtgatcctcc

SEQ ID NO: 10061993 - DNA, 22 bp, Homo sapiens
tcctgggatgacttttgaaatg

SEQ ID NO: 10061994 - DNA, 22 bp, Homo sapiens
tcctgggatgaggaaacaagga

SEQ ID NO: 10061995 - DNA, 22 bp, Homo sapiens
tcctgggatgcataaaatatgt

SEQ ID NO: 10061996 - DNA, 22 bp, Homo sapiens
tcctgggatttgcccttttctc

SEQ ID NO: 10061997 - DNA, 22 bp, Homo sapiens
tcctgggattctgcatttctaa

SEQ ID NO: 10061998 - DNA, 22 bp, Homo sapiens
tcctgggattaaggtggtgatt

SEQ ID NO: 10061999 - DNA, 22 bp, Homo sapiens
tcctggggttttggccgcagct

SEQ ID NO: 10062000 - DNA, 22 bp, Homo sapiens
tcctggccaagtagatgtggcg

SEQ ID NO: 10062001 - DNA, 22 bp, Homo sapiens
tcctggccatgcaagatgagga

SEQ ID NO: 10062002 - DNA, 17 bp, Homo sapiens
tcctggcctggtgtgtg

SEQ ID NO: 10062003 - DNA, 20 bp, Homo sapiens
tcctggcctccctggggctc

SEQ ID NO: 10062004 - DNA, 22 bp, Homo sapiens
tcctggctcgattgctaccaat

SEQ ID NO: 10062005 - DNA, 22 bp, Homo sapiens
tcctggcccactatgccagcat

SEQ ID NO: 10062006 - DNA, 22 bp, Homo sapiens
tcctggcccggccgggcctgct

SEQ ID NO: 10062007 - DNA, 22 bp, Homo sapiens
tcctggcctagagtttgtgttc

SEQ ID NO: 10062008 - DNA, 22 bp, Homo sapiens
tcctggccgccgcgtggggccg

SEQ ID NO: 10062009 - DNA, 22 bp, Homo sapiens
tccttcagaggacggcagccag

SEQ ID NO: 10062010 - DNA, 17 bp, Homo sapiens
tccttcagggcctcaca

SEQ ID NO: 10062011 - DNA, 22 bp, Homo sapiens
tccttaggcaatttgggagagt

SEQ ID NO: 10062012 - DNA, 22 bp, Homo sapiens
tctcagagatgttagggaagag

SEQ ID NO: 10062013 - DNA, 19 bp, Homo sapiens
tctcagagccctagaggcc

SEQ ID NO: 10062014 - DNA, 18 bp, Homo sapiens
tctcagcccagctccggc

SEQ ID NO: 10062015 - DNA, 22 bp, Homo sapiens
tctcagaggtgccctggcatct

SEQ ID NO: 10062016 - DNA, 22 bp, Homo sapiens
tctcagcctcacctctatggag

SEQ ID NO: 10062017 - DNA, 22 bp, Homo sapiens
tctcagggagagctgctggcat

SEQ ID NO: 10062018 - DNA, 22 bp, Homo sapiens
tctcagggtttgtacaagtgta

SEQ ID NO: 10062019 - DNA, 23 bp, Homo sapiens
tctccctcatgcctaggcctggg

SEQ ID NO: 10062020 - DNA, 22 bp, Homo sapiens
tctccttcgaggcccagctccc

SEQ ID NO: 10062021 - DNA, 21 bp, Homo sapiens
tctcctcccggggagaggccg

SEQ ID NO: 10062022 - DNA, 23 bp, Homo sapiens
tctcctcctagatacagtcatgg

SEQ ID NO: 10062023 - DNA, 22 bp, Homo sapiens
tctcctccagaggctgtgggga

SEQ ID NO: 10062024 - DNA, 22 bp, Homo sapiens
tctcctctgcgcggcagtgccc

SEQ ID NO: 10062025 - DNA, 22 bp, Homo sapiens
tctctcagggggaaggctgaag

SEQ ID NO: 10062026 - DNA, 22 bp, Homo sapiens
tctctcagactccccatggttt

SEQ ID NO: 10062027 - DNA, 22 bp, Homo sapiens
tctctcttttttgaacccgctc

SEQ ID NO: 10062028 - DNA, 22 bp, Homo sapiens
tctctctttttaatcatgtaat

SEQ ID NO: 10062029 - DNA, 21 bp, Homo sapiens
tctctgagacactctggagcc

SEQ ID NO: 10062030 - DNA, 22 bp, Homo sapiens
tctgaagaaatacagctggggt

SEQ ID NO: 10062031 - DNA, 22 bp, Homo sapiens
tctcttcctcagcctggggcct

SEQ ID NO: 10062032 - DNA, 22 bp, Homo sapiens
tctcttcctagtgatgggcttt

SEQ ID NO: 10062033 - DNA, 22 bp, Homo sapiens
tctcttccctttatggtatgtg

SEQ ID NO: 10062034 - DNA, 22 bp, Homo sapiens
tctgtgcaagtatttgacattt

SEQ ID NO: 10062035 - DNA, 22 bp, Homo sapiens
tcttcagattgcactgagcaag

SEQ ID NO: 10062036 - DNA, 22 bp, Homo sapiens
tcttccagaatctcagagggct

SEQ ID NO: 10062037 - DNA, 19 bp, Homo sapiens
tcttccagcatctgggggc

SEQ ID NO: 10062038 - DNA, 22 bp, Homo sapiens
tcttccaggagggtgggcaaac

SEQ ID NO: 10062039 - DNA, 22 bp, Homo sapiens
tcttcctccctacagagctcag

SEQ ID NO: 10062040 - DNA, 20 bp, Homo sapiens
tcttccaggtacagtctgca

SEQ ID NO: 10062041 - DNA, 20 bp, Homo sapiens
tcttccagcttctggtagaa

SEQ ID NO: 10062042 - DNA, 22 bp, Homo sapiens
tcttccagcttctggtggctgc

SEQ ID NO: 10062043 - DNA, 22 bp, Homo sapiens
tctgcagcttgcacaggcaggc

SEQ ID NO: 10062044 - DNA, 22 bp, Homo sapiens
tctgccaggccacacagggcac

SEQ ID NO: 10062045 - DNA, 23 bp, Homo sapiens
tctgccagtgtgtgccaggagcc

SEQ ID NO: 10062046 - DNA, 22 bp, Homo sapiens
tctgcctgagcagagggaggcc

SEQ ID NO: 10062047 - DNA, 22 bp, Homo sapiens
tctgcctgccagtctggtcctc

SEQ ID NO: 10062048 - DNA, 22 bp, Homo sapiens
tctgcctgcagtgtggcagggc

SEQ ID NO: 10062049 - DNA, 22 bp, Homo sapiens
tctgcctgccgagaacacctac

SEQ ID NO: 10062050 - DNA, 18 bp, Homo sapiens
tctgcctgcagggcatct

SEQ ID NO: 10062051 - DNA, 22 bp, Homo sapiens
tctgcctgaggactgacaccag

SEQ ID NO: 10062052 - DNA, 22 bp, Homo sapiens
tctgcctgagggagctgaggaa

SEQ ID NO: 10062053 - DNA, 22 bp, Homo sapiens
tctgcctgttcaagtcttctag

SEQ ID NO: 10062054 - DNA, 22 bp, Homo sapiens
tctgcctgtgctgtgttttcat

SEQ ID NO: 10062055 - DNA, 22 bp, Homo sapiens
tctgcctgttcccgattccatg

SEQ ID NO: 10062056 - DNA, 22 bp, Homo sapiens
tctgcctggcctggagggcaca

SEQ ID NO: 10062057 - DNA, 22 bp, Homo sapiens
tctgcctgtagtcccacacctc

SEQ ID NO: 10062058 - DNA, 22 bp, Homo sapiens
tctgcctggcggactcccggaa

SEQ ID NO: 10062059 - DNA, 19 bp, Homo sapiens
tctgcctgcttgtaggggc

SEQ ID NO: 10062060 - DNA, 22 bp, Homo sapiens
tctgcctggaccctggtgagct

SEQ ID NO: 10062061 - DNA, 22 bp, Homo sapiens
tctgcctggagagttcttctct

SEQ ID NO: 10062062 - DNA, 22 bp, Homo sapiens
tctgcctggatgatggcagggc

SEQ ID NO: 10062063 - DNA, 22 bp, Homo sapiens
tctgcctgctaactcctgcacc

SEQ ID NO: 10062064 - DNA, 22 bp, Homo sapiens
tctgcctgcggctgcaggtggc

SEQ ID NO: 10062065 - DNA, 23 bp, Homo sapiens
tctgaccaagttttgcatgccac

SEQ ID NO: 10062066 - DNA, 22 bp, Homo sapiens
tctgaccacagacaacctgcta

SEQ ID NO: 10062067 - DNA, 22 bp, Homo sapiens
tctgaccaggctggctcagggc

SEQ ID NO: 10062068 - DNA, 22 bp, Homo sapiens
tctgaccaggctcagccaaggc

SEQ ID NO: 10062069 - DNA, 23 bp, Homo sapiens
tctgaccatttgacaacatcctg

SEQ ID NO: 10062070 - DNA, 22 bp, Homo sapiens
tctgaccagtgagctctgaaat

SEQ ID NO: 10062071 - DNA, 22 bp, Homo sapiens
tctgaggctgtctctgggctcc

SEQ ID NO: 10062072 - DNA, 19 bp, Homo sapiens
tctgaggcttctccccttg

SEQ ID NO: 10062073 - DNA, 22 bp, Homo sapiens
tctgaggctgaatggactccgt

SEQ ID NO: 10062074 - DNA, 20 bp, Homo sapiens
tctgaggctgagcccagcgt

SEQ ID NO: 10062075 - DNA, 20 bp, Homo sapiens
tctgaggctgagctctactt

SEQ ID NO: 10062076 - DNA, 22 bp, Homo sapiens
tctgaggccctaccctgagcct

SEQ ID NO: 10062077 - DNA, 22 bp, Homo sapiens
tctgaggcctgaagcagcagag

SEQ ID NO: 10062078 - DNA, 17 bp, Homo sapiens
tctgaggcctctaggag

SEQ ID NO: 10062079 - DNA, 22 bp, Homo sapiens
tctgaggcctagagaggggctt

SEQ ID NO: 10062080 - DNA, 22 bp, Homo sapiens
tctgaggccctgcaggcagtgt

SEQ ID NO: 10062081 - DNA, 22 bp, Homo sapiens
tctgaggccttggcagctaagg

SEQ ID NO: 10062082 - DNA, 22 bp, Homo sapiens
tctgaggctatgttcaggctaa

SEQ ID NO: 10062083 - DNA, 22 bp, Homo sapiens
tctggcagaggaaggaggcctg

SEQ ID NO: 10062084 - DNA, 20 bp, Homo sapiens
tctggctctttgctcctccc

SEQ ID NO: 10062085 - DNA, 22 bp, Homo sapiens
acagagcttaggatgactccca

SEQ ID NO: 10062086 - DNA, 22 bp, Homo sapiens
aagaggttgtctgtgatgagtt

SEQ ID NO: 10062087 - DNA, 22 bp, Homo sapiens
aagagccgctccggccagggag

SEQ ID NO: 10062088 - DNA, 20 bp, Homo sapiens
acctgggattagatacccaa

SEQ ID NO: 10062089 - DNA, 22 bp, Homo sapiens
acctgggagtatgcagtggtga

SEQ ID NO: 10062090 - DNA, 22 bp, Homo sapiens
acctgggagtcacacctgagaa

SEQ ID NO: 10062091 - DNA, 22 bp, Homo sapiens
acctgggatggggccaggttta

SEQ ID NO: 10062092 - DNA, 22 bp, Homo sapiens
acctgggaggcagaggttgcag

SEQ ID NO: 10062093 - DNA, 22 bp, Homo sapiens
acctgggagagaggagccggcg

SEQ ID NO: 10062094 - DNA, 22 bp, Homo sapiens
acctgggaggcggaggttgcag

SEQ ID NO: 10062095 - DNA, 22 bp, Homo sapiens
acctgggaaagccgtggaaagg

SEQ ID NO: 10062096 - DNA, 22 bp, Homo sapiens
acctgggaaaaggagtggccat

SEQ ID NO: 10062097 - DNA, 22 bp, Homo sapiens
acctgggaacgctttgtggagg

SEQ ID NO: 10062098 - DNA, 22 bp, Homo sapiens
acctgggaagatctttgaagct

SEQ ID NO: 10062099 - DNA, 20 bp, Homo sapiens
acctgggaaaaccttttcct

SEQ ID NO: 10062100 - DNA, 22 bp, Homo sapiens
actgaccagatctttgagctta

SEQ ID NO: 10062101 - DNA, 22 bp, Homo sapiens
actgaccagatatgtcatacct

SEQ ID NO: 10062102 - DNA, 21 bp, Homo sapiens
actgaccacttctgcctgtct

SEQ ID NO: 10062103 - DNA, 22 bp, Homo sapiens
acagtgtcatcagtttctcaac

SEQ ID NO: 10062104 - DNA, 22 bp, Homo sapiens
acaggtgattcaggctctggga

SEQ ID NO: 10062105 - DNA, 20 bp, Homo sapiens
acaggagatctgaggaaagg

SEQ ID NO: 10062106 - DNA, 22 bp, Homo sapiens
acaggagcaacagactaagaca

SEQ ID NO: 10062107 - DNA, 22 bp, Homo sapiens
acaggagctctagggacagcac

SEQ ID NO: 10062108 - DNA, 22 bp, Homo sapiens
acaggaggagcagctgtgtgcc

SEQ ID NO: 10062109 - DNA, 22 bp, Homo sapiens
accacccagccagcttctccct

SEQ ID NO: 10062110 - DNA, 22 bp, Homo sapiens
accacagtttagtccaatgaca

SEQ ID NO: 10062111 - DNA, 20 bp, Homo sapiens
acagaactgagaacagtctc

SEQ ID NO: 10062112 - DNA, 18 bp, Homo sapiens
acagaactgagatttgag

SEQ ID NO: 10062113 - DNA, 18 bp, Homo sapiens
acagaactcaggggcacc

SEQ ID NO: 10062114 - DNA, 22 bp, Homo sapiens
acagaactgcagacagtgccaa

SEQ ID NO: 10062115 - DNA, 22 bp, Homo sapiens
agccaggcgcagtggcttatgc

SEQ ID NO: 10062116 - DNA, 20 bp, Homo sapiens
agccaggctcaagctccccc

SEQ ID NO: 10062117 - DNA, 22 bp, Homo sapiens
agccaggctactccttgctgac

SEQ ID NO: 10062118 - DNA, 22 bp, Homo sapiens
agccaggcgggtctttgctcct

SEQ ID NO: 10062119 - DNA, 22 bp, Homo sapiens
agccaggctaaatgagccatga

SEQ ID NO: 10062120 - DNA, 22 bp, Homo sapiens
agcctgtgacattgactatgaa

SEQ ID NO: 10062121 - DNA, 22 bp, Homo sapiens
agcctggctgggaagagcctct

SEQ ID NO: 10062122 - DNA, 22 bp, Homo sapiens
agctcaggtcattccagggatg

SEQ ID NO: 10062123 - DNA, 22 bp, Homo sapiens
agctcagggctccaggaccgct

SEQ ID NO: 10062124 - DNA, 22 bp, Homo sapiens
agctcaggccggagctacaggc

SEQ ID NO: 10062125 - DNA, 22 bp, Homo sapiens
agctcagggccatcggcccttt

SEQ ID NO: 10062126 - DNA, 22 bp, Homo sapiens
agctcaggctctgcagggacta

SEQ ID NO: 10062127 - DNA, 22 bp, Homo sapiens
agcagctgagccccagctgtga

SEQ ID NO: 10062128 - DNA, 22 bp, Homo sapiens
agcagctgaccagtgagtcctg

SEQ ID NO: 10062129 - DNA, 22 bp, Homo sapiens
agcagggcttctgtgcctgtgc

SEQ ID NO: 10062130 - DNA, 22 bp, Homo sapiens
agcagggcctctggcactggtc

SEQ ID NO: 10062131 - DNA, 22 bp, Homo sapiens
agcagggctgtgctccttccga

SEQ ID NO: 10062132 - DNA, 22 bp, Homo sapiens
agcagggctttgtctctgtgaa

SEQ ID NO: 10062133 - DNA, 22 bp, Homo sapiens
acacagaacctcatagcctctc

SEQ ID NO: 10062134 - DNA, 23 bp, Homo sapiens
agcagccagagatcctcggccct

SEQ ID NO: 10062135 - DNA, 22 bp, Homo sapiens
acacacagaaggaagccccact

SEQ ID NO: 10062136 - DNA, 22 bp, Homo sapiens
agagatcccttctgcctgggga

SEQ ID NO: 10062137 - DNA, 22 bp, Homo sapiens
agactgagactggggaaagaca

SEQ ID NO: 10062138 - DNA, 22 bp, Homo sapiens
agacactggcactggggaagcc

SEQ ID NO: 10062139 - DNA, 23 bp, Homo sapiens
agaggccaacttcttgcccctcc

SEQ ID NO: 10062140 - DNA, 17 bp, Homo sapiens
agcctgggaaggagtga

SEQ ID NO: 10062141 - DNA, 22 bp, Homo sapiens
agcctgggaatttagagttcgg

SEQ ID NO: 10062142 - DNA, 22 bp, Homo sapiens
agcctgggagacactaagttgt

SEQ ID NO: 10062143 - DNA, 21 bp, Homo sapiens
agcctgggaggcggaggttgc

SEQ ID NO: 10062144 - DNA, 22 bp, Homo sapiens
agcctgggcaactccattcact

SEQ ID NO: 10062145 - DNA, 22 bp, Homo sapiens
agcctgggcaacagagcaaaac

SEQ ID NO: 10062146 - DNA, 22 bp, Homo sapiens
agcctgggcaacaacacagcga

SEQ ID NO: 10062147 - DNA, 22 bp, Homo sapiens
agcctgggcctggcttcccgcc

SEQ ID NO: 10062148 - DNA, 18 bp, Homo sapiens
agcctgggctctgcctgg

SEQ ID NO: 10062149 - DNA, 22 bp, Homo sapiens
agcctgggccctgcctcttctc

SEQ ID NO: 10062150 - DNA, 22 bp, Homo sapiens
agcctggggcacttctccaaac

SEQ ID NO: 10062151 - DNA, 22 bp, Homo sapiens
agcctggggtttcagtttgcac

SEQ ID NO: 10062152 - DNA, 22 bp, Homo sapiens
agcctgggtttttattaaggag

SEQ ID NO: 10062153 - DNA, 22 bp, Homo sapiens
agcctgggttagggttcttccc

SEQ ID NO: 10062154 - DNA, 22 bp, Homo sapiens
agctaggacaggtagagatggg

SEQ ID NO: 10062155 - DNA, 22 bp, Homo sapiens
agccctggagcaaaggtgtctt

SEQ ID NO: 10062156 - DNA, 22 bp, Homo sapiens
agccctgggcgttactgggatg

SEQ ID NO: 10062157 - DNA, 22 bp, Homo sapiens
agccaggccagctgtcttgagt

SEQ ID NO: 10062158 - DNA, 22 bp, Homo sapiens
agccaggccttagggagaggca

SEQ ID NO: 10062159 - DNA, 20 bp, Homo sapiens
agccaggcctcaagttaagt

SEQ ID NO: 10062160 - DNA, 22 bp, Homo sapiens
cagagctcagagctgccaggca

SEQ ID NO: 10062161 - DNA, 20 bp, Homo sapiens
cagagaccaggccaggtgtc

SEQ ID NO: 10062162 - DNA, 22 bp, Homo sapiens
cagagaactccagtggctggcg

SEQ ID NO: 10062163 - DNA, 22 bp, Homo sapiens
cagagacccctggcatggtggt

SEQ ID NO: 10062164 - DNA, 22 bp, Homo sapiens
cagagaccctaggcaggtgaca

SEQ ID NO: 10062165 - DNA, 22 bp, Homo sapiens
agccaggccagactcacaccct

SEQ ID NO: 10062166 - DNA, 22 bp, Homo sapiens
agcagggcaaagtcaggctaac

SEQ ID NO: 10062167 - DNA, 17 bp, Homo sapiens
agcagctggcacaggag

SEQ ID NO: 10062168 - DNA, 19 bp, Homo sapiens
agcagctggaggtggagtg

SEQ ID NO: 10062169 - DNA, 23 bp, Homo sapiens
agcagccctgggacctggcctgc

SEQ ID NO: 10062170 - DNA, 22 bp, Homo sapiens
agaggctccttcactctggcac

SEQ ID NO: 10062171 - DNA, 22 bp, Homo sapiens
agagccaggccaggccggggca

SEQ ID NO: 10062172 - DNA, 23 bp, Homo sapiens
agagcctgaaagacttctggcac

SEQ ID NO: 10062173 - DNA, 22 bp, Homo sapiens
agagcctgagcctgaaagccct

SEQ ID NO: 10062174 - DNA, 22 bp, Homo sapiens
agagcctgagcctgatcttgaa

SEQ ID NO: 10062175 - DNA, 22 bp, Homo sapiens
agagcctgcagctgtgaagaaa

SEQ ID NO: 10062176 - DNA, 22 bp, Homo sapiens
agagcctgaggccctgagaggg

SEQ ID NO: 10062177 - DNA, 22 bp, Homo sapiens
atctgcctggctccaggtgagc

SEQ ID NO: 10062178 - DNA, 22 bp, Homo sapiens
actctcttgggggagagcagag

SEQ ID NO: 10062179 - DNA, 22 bp, Homo sapiens
actgcctgagctattggaaaag

SEQ ID NO: 10062180 - DNA, 22 bp, Homo sapiens
actgcctggcctggcctcactg

SEQ ID NO: 10062181 - DNA, 22 bp, Homo sapiens
actgcctgccttccaggtactg

SEQ ID NO: 10062182 - DNA, 22 bp, Homo sapiens
actctgcctttcagcagatgaa

SEQ ID NO: 10062183 - DNA, 21 bp, Homo sapiens
actctgccagtctcctgcact

SEQ ID NO: 10062184 - DNA, 22 bp, Homo sapiens
aggctccagcagccagaggaag

SEQ ID NO: 10062185 - DNA, 22 bp, Homo sapiens
aggctccacggtcactggctct

SEQ ID NO: 10062186 - DNA, 22 bp, Homo sapiens
aggctccagcccaaggctgcag

SEQ ID NO: 10062187 - DNA, 22 bp, Homo sapiens
aggcttcccaagcagctgcaaa

SEQ ID NO: 10062188 - DNA, 22 bp, Homo sapiens
acccagggttcctgggtcccag

SEQ ID NO: 10062189 - DNA, 22 bp, Homo sapiens
agggcctgagctctcctccagt

SEQ ID NO: 10062190 - DNA, 22 bp, Homo sapiens
agggcctctggaacactgaggg

SEQ ID NO: 10062191 - DNA, 22 bp, Homo sapiens
agggcctgacacccttgccagc

SEQ ID NO: 10062192 - DNA, 22 bp, Homo sapiens
acccatgtttatttgtgtggtt

SEQ ID NO: 10062193 - DNA, 19 bp, Homo sapiens
accaggagacagtgagctt

SEQ ID NO: 10062194 - DNA, 22 bp, Homo sapiens
agggcctcgggctcagtgggtc

SEQ ID NO: 10062195 - DNA, 22 bp, Homo sapiens
agggcctcgaaggcagagggat

SEQ ID NO: 10062196 - DNA, 19 bp, Homo sapiens
accaggagtatcagagctg

SEQ ID NO: 10062197 - DNA, 22 bp, Homo sapiens
accaggagtctagcctagtcaa

SEQ ID NO: 10062198 - DNA, 22 bp, Homo sapiens
aggaaggcttctttggtcttct

SEQ ID NO: 10062199 - DNA, 20 bp, Homo sapiens
aggagccattgactgcagca

SEQ ID NO: 10062200 - DNA, 22 bp, Homo sapiens
agctgggatgataacctcagtc

SEQ ID NO: 10062201 - DNA, 22 bp, Homo sapiens
agctgggaggtgggcagtgaga

SEQ ID NO: 10062202 - DNA, 22 bp, Homo sapiens
agctgggaggctcctctgtgac

SEQ ID NO: 10062203 - DNA, 22 bp, Homo sapiens
agctgggatgaggagcatcctt

SEQ ID NO: 10062204 - DNA, 22 bp, Homo sapiens
agctgggagcagagccacagcc

SEQ ID NO: 10062205 - DNA, 22 bp, Homo sapiens
agctgggagctgaaggctgatt

SEQ ID NO: 10062206 - DNA, 22 bp, Homo sapiens
aggtcagacacagtgctgggtg

SEQ ID NO: 10062207 - DNA, 22 bp, Homo sapiens
ccttccagagttcagtctgccc

SEQ ID NO: 10062208 - DNA, 22 bp, Homo sapiens
ccttccagggagcaggcagtgt

SEQ ID NO: 10062209 - DNA, 22 bp, Homo sapiens
ccttccaggagtctctgcaggt

SEQ ID NO: 10062210 - DNA, 22 bp, Homo sapiens
cctggggctctgcacagagcag

SEQ ID NO: 10062211 - DNA, 22 bp, Homo sapiens
cctgggtatagaagagccgctg

SEQ ID NO: 10062212 - DNA, 22 bp, Homo sapiens
agtcctgggtctggagaatgga

SEQ ID NO: 10062213 - DNA, 22 bp, Homo sapiens
ctaggcagactgagctctaggg

SEQ ID NO: 10062214 - DNA, 22 bp, Homo sapiens
agtaaaaattgaggtgcaaaat

SEQ ID NO: 10062215 - DNA, 22 bp, Homo sapiens
ccttccaggtgcaggcaagcct

SEQ ID NO: 10062216 - DNA, 22 bp, Homo sapiens
ccttccaggttttggctccatt

SEQ ID NO: 10062217 - DNA, 22 bp, Homo sapiens
agtgtcctcctctgggagccag

SEQ ID NO: 10062218 - DNA, 22 bp, Homo sapiens
ctggccagaggttcctctgccc

SEQ ID NO: 10062219 - DNA, 20 bp, Homo sapiens
ctggccagaacgcctacaca

SEQ ID NO: 10062220 - DNA, 22 bp, Homo sapiens
ctggccactggaggtggcaccc

SEQ ID NO: 10062221 - DNA, 22 bp, Homo sapiens
ctgctgtgggcagggtagctgg

SEQ ID NO: 10062222 - DNA, 22 bp, Homo sapiens
ctgctgcccagtgtgcattggg

SEQ ID NO: 10062223 - DNA, 22 bp, Homo sapiens
ctgcctgtgccaatgctccttt

SEQ ID NO: 10062224 - DNA, 22 bp, Homo sapiens
ctgcctggtctcaggcatgggg

SEQ ID NO: 10062225 - DNA, 22 bp, Homo sapiens
ctgcctgggttcaagtcctgtt

SEQ ID NO: 10062226 - DNA, 22 bp, Homo sapiens
ctgcctggaaggagcaagggga

SEQ ID NO: 10062227 - DNA, 22 bp, Homo sapiens
aggagccaaattactagctctg

SEQ ID NO: 10062228 - DNA, 22 bp, Homo sapiens
aggagccacctaggagctgttt

SEQ ID NO: 10062229 - DNA, 22 bp, Homo sapiens
agctgcctgccatgccgctggt

SEQ ID NO: 10062230 - DNA, 23 bp, Homo sapiens
agctgggccaggtggtcagacct

SEQ ID NO: 10062231 - DNA, 22 bp, Homo sapiens
agctgggcagactgcagtggtt

SEQ ID NO: 10062232 - DNA, 22 bp, Homo sapiens
cagggttgcatgcatctgtggg

SEQ ID NO: 10062233 - DNA, 22 bp, Homo sapiens
cagggttgattccttctgaggg

SEQ ID NO: 10062234 - DNA, 22 bp, Homo sapiens
cagggttgatgaattgtctgta

SEQ ID NO: 10062235 - DNA, 22 bp, Homo sapiens
caggtcctggcatcaggcaggt

SEQ ID NO: 10062236 - DNA, 22 bp, Homo sapiens
cccatgggttttcctccctgcc

SEQ ID NO: 10062237 - DNA, 22 bp, Homo sapiens
ccctcccagatgggcttgaggt

SEQ ID NO: 10062238 - DNA, 23 bp, Homo sapiens
cccaggagcctgagtcctctctg

SEQ ID NO: 10062239 - DNA, 18 bp, Homo sapiens
cccaggctttgtgggtct

SEQ ID NO: 10062240 - DNA, 22 bp, Homo sapiens
cccaggctggaattccaggcct

SEQ ID NO: 10062241 - DNA, 22 bp, Homo sapiens
cccaggaggtcgaagctgcagt

SEQ ID NO: 10062242 - DNA, 22 bp, Homo sapiens
cccaggctgatgggatgggcca

SEQ ID NO: 10062243 - DNA, 22 bp, Homo sapiens
agggctggctccgttaccttga

SEQ ID NO: 10062244 - DNA, 22 bp, Homo sapiens
agggctggccacatgatttggt

SEQ ID NO: 10062245 - DNA, 22 bp, Homo sapiens
agggctggctaggtgcgttccc

SEQ ID NO: 10062246 - DNA, 22 bp, Homo sapiens
agggcctgctctatcactctca

SEQ ID NO: 10062247 - DNA, 22 bp, Homo sapiens
agggcctggaactgtgggcagg

SEQ ID NO: 10062248 - DNA, 22 bp, Homo sapiens
agggcgacaatggagagcgttt

SEQ ID NO: 10062249 - DNA, 22 bp, Homo sapiens
cctcaggccagggggcggccag

SEQ ID NO: 10062250 - DNA, 22 bp, Homo sapiens
cctcaggccctgtccctgcgcc

SEQ ID NO: 10062251 - DNA, 22 bp, Homo sapiens
agggctggcaagggattgaaat

SEQ ID NO: 10062252 - DNA, 22 bp, Homo sapiens
agggctggcatctctaatgctg

SEQ ID NO: 10062253 - DNA, 22 bp, Homo sapiens
agggctggagggtactagttta

SEQ ID NO: 10062254 - DNA, 22 bp, Homo sapiens
agggctggagccacagctggga

SEQ ID NO: 10062255 - DNA, 22 bp, Homo sapiens
aggcctgtctgaggtccccact

SEQ ID NO: 10062256 - DNA, 22 bp, Homo sapiens
aggcctgtaatcccagcacttt

SEQ ID NO: 10062257 - DNA, 22 bp, Homo sapiens
aggcctctggaggtggcagtgt

SEQ ID NO: 10062258 - DNA, 17 bp, Homo sapiens
aggcctctgccggtgcc

SEQ ID NO: 10062259 - DNA, 22 bp, Homo sapiens
ccagagcctggcatctgcataa

SEQ ID NO: 10062260 - DNA, 22 bp, Homo sapiens
ccagagctgagggagcctgagc

SEQ ID NO: 10062261 - DNA, 20 bp, Homo sapiens
ccagagctgatggctgcccg

SEQ ID NO: 10062262 - DNA, 22 bp, Homo sapiens
ccagaccctttcttggcatgtg

SEQ ID NO: 10062263 - DNA, 22 bp, Homo sapiens
ccagaccctgctctggggctct

SEQ ID NO: 10062264 - DNA, 22 bp, Homo sapiens
ccagaccctccattcaagctcc

SEQ ID NO: 10062265 - DNA, 22 bp, Homo sapiens
ccagggcctgagggcgacgccc

SEQ ID NO: 10062266 - DNA, 22 bp, Homo sapiens
ccagggcctgccacttagcaag

SEQ ID NO: 10062267 - DNA, 22 bp, Homo sapiens
ccagggcaggagaaagactcac

SEQ ID NO: 10062268 - DNA, 22 bp, Homo sapiens
ccagggctggaccagtgcttgg

SEQ ID NO: 10062269 - DNA, 22 bp, Homo sapiens
ccagggctccattgctcatcct

SEQ ID NO: 10062270 - DNA, 22 bp, Homo sapiens
aggctgggaaggtaaagttgta

SEQ ID NO: 10062271 - DNA, 22 bp, Homo sapiens
aggctgggtacctgtcatatgc

SEQ ID NO: 10062272 - DNA, 20 bp, Homo sapiens
aggctggggtgttttgccca

SEQ ID NO: 10062273 - DNA, 22 bp, Homo sapiens
aggctgggcaccgttttgatcc

SEQ ID NO: 10062274 - DNA, 22 bp, Homo sapiens
aggctgggctccgcccaactcc

SEQ ID NO: 10062275 - DNA, 22 bp, Homo sapiens
aggctggggaattgaatttgct

SEQ ID NO: 10062276 - DNA, 22 bp, Homo sapiens
cactgcctctgcctcctgggtt

SEQ ID NO: 10062277 - DNA, 22 bp, Homo sapiens
cactgcctccccaggctccaca

SEQ ID NO: 10062278 - DNA, 22 bp, Homo sapiens
ggctgggagctggacaggccgg

SEQ ID NO: 10062279 - DNA, 23 bp, Homo sapiens
ggctgggagctccgggtgcacgt

SEQ ID NO: 10062280 - DNA, 22 bp, Homo sapiens
ggctgggacgatgaggattagt

SEQ ID NO: 10062281 - DNA, 22 bp, Homo sapiens
ggctgggagccccacagagtca

SEQ ID NO: 10062282 - DNA, 22 bp, Homo sapiens
cacccaggcaaggattctgcaa

SEQ ID NO: 10062283 - DNA, 22 bp, Homo sapiens
cacccaggcaggtggctgagaa

SEQ ID NO: 10062284 - DNA, 22 bp, Homo sapiens
cacccaggacaaaatatggaat

SEQ ID NO: 10062285 - DNA, 22 bp, Homo sapiens
ggcccagaagccagaagcctcc

SEQ ID NO: 10062286 - DNA, 22 bp, Homo sapiens
ggcccagagctccctggcacct

SEQ ID NO: 10062287 - DNA, 22 bp, Homo sapiens
ggcccagaggggttgagcatct

SEQ ID NO: 10062288 - DNA, 18 bp, Homo sapiens
cacaggagatgacctgac

SEQ ID NO: 10062289 - DNA, 22 bp, Homo sapiens
cacaggagaggttaatgggggc

SEQ ID NO: 10062290 - DNA, 22 bp, Homo sapiens
cacaggagagctgggaggtgcc

SEQ ID NO: 10062291 - DNA, 19 bp, Homo sapiens
cacagctctgctcagggaa

SEQ ID NO: 10062292 - DNA, 22 bp, Homo sapiens
gctggccatagaagccaaagag

SEQ ID NO: 10062293 - DNA, 22 bp, Homo sapiens
gcttccagcaccagcagagggg

SEQ ID NO: 10062294 - DNA, 20 bp, Homo sapiens
cagcctccactcactcagct

SEQ ID NO: 10062295 - DNA, 22 bp, Homo sapiens
gtgcctgggacttgctccggat

SEQ ID NO: 10062296 - DNA, 22 bp, Homo sapiens
gtgcctgggcatgagcttgttg

SEQ ID NO: 10062297 - DNA, 22 bp, Homo sapiens
gtgcctgggggtaatgtaggat

SEQ ID NO: 10062298 - DNA, 22 bp, Homo sapiens
gtgcctggtttggggagtgttc

SEQ ID NO: 10062299 - DNA, 22 bp, Homo sapiens
gtgcctggtttggggaatgttc

SEQ ID NO: 10062300 - DNA, 22 bp, Homo sapiens
gtgcctggggttgagctatgaa

SEQ ID NO: 10062301 - DNA, 22 bp, Homo sapiens
gtgcctggtatgtaggtagcgg

SEQ ID NO: 10062302 - DNA, 22 bp, Homo sapiens
cagctcccagagtgaccagcag

SEQ ID NO: 10062303 - DNA, 22 bp, Homo sapiens
gtcctctgtgtaggctgcagac

SEQ ID NO: 10062304 - DNA, 22 bp, Homo sapiens
ggtgcagcctccccagtgacag

SEQ ID NO: 10062305 - DNA, 22 bp, Homo sapiens
ggtgtctgttgcctcctggtta

SEQ ID NO: 10062306 - DNA, 22 bp, Homo sapiens
ggtgtctggacagtgagccagg

SEQ ID NO: 10062307 - DNA, 22 bp, Homo sapiens
cagcactgctgctgtacacaca

SEQ ID NO: 10062308 - DNA, 22 bp, Homo sapiens
gggctcaggcctggcctctcac

SEQ ID NO: 10062309 - DNA, 19 bp, Homo sapiens
gccctcctcactgagctct

SEQ ID NO: 10062310 - DNA, 18 bp, Homo sapiens
gcctgccatccccacagc

SEQ ID NO: 10062311 - DNA, 22 bp, Homo sapiens
gcctgcctagaattgcagcttt

SEQ ID NO: 10062312 - DNA, 22 bp, Homo sapiens
gctcaggggaatgggctgccgt

SEQ ID NO: 10062313 - DNA, 23 bp, Homo sapiens
gctcaggcatcattcttcctggc

SEQ ID NO: 10062314 - DNA, 22 bp, Homo sapiens
gcctggctcgggcactcgccag

SEQ ID NO: 10062315 - DNA, 22 bp, Homo sapiens
gcaggagcaatggcctatcaga

SEQ ID NO: 10062316 - DNA, 22 bp, Homo sapiens
gcaggagcaaactgcagtgtgg

SEQ ID NO: 10062317 - DNA, 20 bp, Homo sapiens
gccacagttttctcactgca

SEQ ID NO: 10062318 - DNA, 22 bp, Homo sapiens
attgttcagagaagggaagaat

SEQ ID NO: 10062319 - DNA, 22 bp, Homo sapiens
gcagaggctgggtgtcccagtc

SEQ ID NO: 10062320 - DNA, 22 bp, Homo sapiens
gcagaggctctttaatgcttag

SEQ ID NO: 10062321 - DNA, 22 bp, Homo sapiens
gcagcctgttgtaccagcctgt

SEQ ID NO: 10062322 - DNA, 19 bp, Homo sapiens
gcagccaggtgctctacct

SEQ ID NO: 10062323 - DNA, 22 bp, Homo sapiens
atgcctcctgtgccactgtgat

SEQ ID NO: 10062324 - DNA, 22 bp, Homo sapiens
gaagaaacaggggcttggggag

SEQ ID NO: 10062325 - DNA, 22 bp, Homo sapiens
cttgaggctgcactccagggcc

SEQ ID NO: 10062326 - DNA, 22 bp, Homo sapiens
tgcagggccttctagaccatgg

SEQ ID NO: 10062327 - DNA, 22 bp, Homo sapiens
tgcagggccttgggtctttctt

SEQ ID NO: 10062328 - DNA, 22 bp, Homo sapiens
cccagagctgagggggcacgtt

SEQ ID NO: 10062329 - DNA, 22 bp, Homo sapiens
cccagagctgggtgggcagcgg

SEQ ID NO: 10062330 - DNA, 22 bp, Homo sapiens
ccagggctgctcattggctggt

SEQ ID NO: 10062331 - DNA, 22 bp, Homo sapiens
ccagggctgcctggccgtgtgt

SEQ ID NO: 10062332 - DNA, 22 bp, Homo sapiens
ccagtggacttctccctgtggt

SEQ ID NO: 10062333 - DNA, 22 bp, Homo sapiens
ccagggcatcacatccagtgtt

SEQ ID NO: 10062334 - DNA, 22 bp, Homo sapiens
ccagggcagtgggagaaggtgc

SEQ ID NO: 10062335 - DNA, 22 bp, Homo sapiens
ccagggctgccgcatccctggt

SEQ ID NO: 10062336 - DNA, 22 bp, Homo sapiens
ccagggctgagctgtgaccatg

SEQ ID NO: 10062337 - DNA, 22 bp, Homo sapiens
ccagggctctgcttctgccatg

SEQ ID NO: 10062338 - DNA, 22 bp, Homo sapiens
ccagggcctcgtgttctgagtg

SEQ ID NO: 10062339 - DNA, 22 bp, Homo sapiens
ccagggctcgggtgcttagtca

SEQ ID NO: 10062340 - DNA, 22 bp, Homo sapiens
ccagggctctatgagggtggag

SEQ ID NO: 10062341 - DNA, 22 bp, Homo sapiens
ccagggcagggaccacgtgtct

SEQ ID NO: 10062342 - DNA, 22 bp, Homo sapiens
ccagggcacgttgggacagtac

SEQ ID NO: 10062343 - DNA, 22 bp, Homo sapiens
ccagggcaattatttggagggt

SEQ ID NO: 10062344 - DNA, 22 bp, Homo sapiens
ccagggcaacgctgtctcagag

SEQ ID NO: 10062345 - DNA, 22 bp, Homo sapiens
ccaggcctgcatctgctgcgca

SEQ ID NO: 10062346 - DNA, 23 bp, Homo sapiens
ccaggcctctcagagggtgtgcc

SEQ ID NO: 10062347 - DNA, 19 bp, Homo sapiens
ccaggcctctggggcctgt

SEQ ID NO: 10062348 - DNA, 22 bp, Homo sapiens
ccaggagagcaaaggtcactct

SEQ ID NO: 10062349 - DNA, 22 bp, Homo sapiens
tctgttcagaaatggaagtgcc

SEQ ID NO: 10062350 - DNA, 19 bp, Homo sapiens
ccaggagcagtggtgagct

SEQ ID NO: 10062351 - DNA, 22 bp, Homo sapiens
ccaggagccactcaggcccaca

SEQ ID NO: 10062352 - DNA, 22 bp, Homo sapiens
ccaggagcattaagagaacata

SEQ ID NO: 10062353 - DNA, 22 bp, Homo sapiens
ccaggagcaggagctggacaga

SEQ ID NO: 10062354 - DNA, 22 bp, Homo sapiens
ccaggagcaggagctgcagctg

SEQ ID NO: 10062355 - DNA, 22 bp, Homo sapiens
ccaggagcagatatggacataa

SEQ ID NO: 10062356 - DNA, 22 bp, Homo sapiens
ccaggagcaccaggcctgtgcc

SEQ ID NO: 10062357 - DNA, 22 bp, Homo sapiens
ccaggcctcctgtgagtggacc

SEQ ID NO: 10062358 - DNA, 19 bp, Homo sapiens
ccaggcctcctgggaggtc

SEQ ID NO: 10062359 - DNA, 22 bp, Homo sapiens
cctcctctgtgcagctgtgggt

SEQ ID NO: 10062360 - DNA, 22 bp, Homo sapiens
cctcccacatcctagctctgct

SEQ ID NO: 10062361 - DNA, 22 bp, Homo sapiens
cctcccacttcttgctgaggtc

SEQ ID NO: 10062362 - DNA, 22 bp, Homo sapiens
cctcccaccgtatctcagtggc

SEQ ID NO: 10062363 - DNA, 22 bp, Homo sapiens
cctccagggcccctctcactgg

SEQ ID NO: 10062364 - DNA, 22 bp, Homo sapiens
cctctcccctcccaaggcggga

SEQ ID NO: 10062365 - DNA, 22 bp, Homo sapiens
tgggacagggaatctgatcccc

SEQ ID NO: 10062366 - DNA, 22 bp, Homo sapiens
cctgcccagagcccctttcact

SEQ ID NO: 10062367 - DNA, 22 bp, Homo sapiens
cctgcccagcttcacctcaggc

SEQ ID NO: 10062368 - DNA, 19 bp, Homo sapiens
cctgcctgagctgtccctc

SEQ ID NO: 10062369 - DNA, 19 bp, Homo sapiens
cctgcctgaccccggctac

SEQ ID NO: 10062370 - DNA, 22 bp, Homo sapiens
cctgcctgaaggtcagccaccc

SEQ ID NO: 10062371 - DNA, 22 bp, Homo sapiens
cctgcctcccagaggtcctcta

SEQ ID NO: 10062372 - DNA, 22 bp, Homo sapiens
tgcagggctaagtcagagcctg

SEQ ID NO: 10062373 - DNA, 22 bp, Homo sapiens
tgctcaggacagtggaacctaa

SEQ ID NO: 10062374 - DNA, 20 bp, Homo sapiens
tgctcaggatggagaggtgt

SEQ ID NO: 10062375 - DNA, 22 bp, Homo sapiens
tgctcagggagcttcctggtgg

SEQ ID NO: 10062376 - DNA, 22 bp, Homo sapiens
tgctcagggacaatggagaggg

SEQ ID NO: 10062377 - DNA, 19 bp, Homo sapiens
tgctcaggccaaggagccc

SEQ ID NO: 10062378 - DNA, 22 bp, Homo sapiens
tgctcaggccagccggacagag

SEQ ID NO: 10062379 - DNA, 22 bp, Homo sapiens
ccctgggagtccactgatgtca

SEQ ID NO: 10062380 - DNA, 22 bp, Homo sapiens
ccctgggacccgctgcagaggc

SEQ ID NO: 10062381 - DNA, 22 bp, Homo sapiens
ccctgggaagtattccagctat

SEQ ID NO: 10062382 - DNA, 22 bp, Homo sapiens
ccctgggaggcttccaggcaga

SEQ ID NO: 10062383 - DNA, 22 bp, Homo sapiens
ccctgggagctgcctggctgac

SEQ ID NO: 10062384 - DNA, 22 bp, Homo sapiens
ccctgggagaagttgagggctg

SEQ ID NO: 10062385 - DNA, 22 bp, Homo sapiens
tggagacctctacccatctcct

SEQ ID NO: 10062386 - DNA, 22 bp, Homo sapiens
ccctccctttgcagcagtgcat

SEQ ID NO: 10062387 - DNA, 22 bp, Homo sapiens
tccaggctttggggcaggagcg

SEQ ID NO: 10062388 - DNA, 22 bp, Homo sapiens
tccaggcttgagaccaggctct

SEQ ID NO: 10062389 - DNA, 22 bp, Homo sapiens
tccaggctgtgcgcaccgtgtg

SEQ ID NO: 10062390 - DNA, 22 bp, Homo sapiens
tcagtgtgcacgatacagattg

SEQ ID NO: 10062391 - DNA, 23 bp, Homo sapiens
tcagtgtgcaagaatggagaagc

SEQ ID NO: 10062392 - DNA, 22 bp, Homo sapiens
tcagtgtgtacactgagcattt

SEQ ID NO: 10062393 - DNA, 22 bp, Homo sapiens
tcagtgtgtaattctttgtttc

SEQ ID NO: 10062394 - DNA, 22 bp, Homo sapiens
tcagtgtgaattcaggagccta

SEQ ID NO: 10062395 - DNA, 21 bp, Homo sapiens
tcagtgtgactggcaaattga

SEQ ID NO: 10062396 - DNA, 22 bp, Homo sapiens
tcagtgtgattaggctatctga

SEQ ID NO: 10062397 - DNA, 22 bp, Homo sapiens
tcagtgtgagtaccatgctcag

SEQ ID NO: 10062398 - DNA, 22 bp, Homo sapiens
tcagtgtgaggggctgggtcct

SEQ ID NO: 10062399 - DNA, 22 bp, Homo sapiens
ccagagccagagaggtgcctgc

SEQ ID NO: 10062400 - DNA, 22 bp, Homo sapiens
ccagagcccagggtcatgcagg

SEQ ID NO: 10062401 - DNA, 22 bp, Homo sapiens
ccagagcccagcacacggtgct

SEQ ID NO: 10062402 - DNA, 22 bp, Homo sapiens
ccagagcccctgagcttccctg

SEQ ID NO: 10062403 - DNA, 19 bp, Homo sapiens
ccagagcccgccagatggg

SEQ ID NO: 10062404 - DNA, 22 bp, Homo sapiens
ccagagccggctccctcagctt

SEQ ID NO: 10062405 - DNA, 22 bp, Homo sapiens
ccagagccggattgtgaagtgc

SEQ ID NO: 10062406 - DNA, 22 bp, Homo sapiens
ccagagcctcaacacaggtcct

SEQ ID NO: 10062407 - DNA, 22 bp, Homo sapiens
ccagagcctaagatctgatcct

SEQ ID NO: 10062408 - DNA, 22 bp, Homo sapiens
ccagagcctcgcccggagcctc

SEQ ID NO: 10062409 - DNA, 21 bp, Homo sapiens
ccagagcctgagaggattatg

SEQ ID NO: 10062410 - DNA, 23 bp, Homo sapiens
tcctgctgaaagctccagctggc

SEQ ID NO: 10062411 - DNA, 21 bp, Homo sapiens
tcctgccttagtccagagcag

SEQ ID NO: 10062412 - DNA, 22 bp, Homo sapiens
ccacagggcacaagggaggttg

SEQ ID NO: 10062413 - DNA, 22 bp, Homo sapiens
ccacagggataggaatggggct

SEQ ID NO: 10062414 - DNA, 22 bp, Homo sapiens
tcctggccttagcgaggcggtc

SEQ ID NO: 10062415 - DNA, 22 bp, Homo sapiens
cagggccaagctgcagcatctg

SEQ ID NO: 10062416 - DNA, 22 bp, Homo sapiens
cagggcagtttgtgcctatgag

SEQ ID NO: 10062417 - DNA, 22 bp, Homo sapiens
cagggagaggcatcatagggaa

SEQ ID NO: 10062418 - DNA, 22 bp, Homo sapiens
caggccctgccttgagggacct

SEQ ID NO: 10062419 - DNA, 22 bp, Homo sapiens
caggccctcaggcaagggctct

SEQ ID NO: 10062420 - DNA, 22 bp, Homo sapiens
caggccacacggcggctccctg

SEQ ID NO: 10062421 - DNA, 22 bp, Homo sapiens
caggctcctcactcatgctccc

SEQ ID NO: 10062422 - DNA, 20 bp, Homo sapiens
caggctccgcaggactaggg

SEQ ID NO: 10062423 - DNA, 22 bp, Homo sapiens
caggctccctaagtcagcagcc

SEQ ID NO: 10062424 - DNA, 22 bp, Homo sapiens
caggctccctgggcagtggcag

SEQ ID NO: 10062425 - DNA, 22 bp, Homo sapiens
caggctccctgcaggccagtga

SEQ ID NO: 10062426 - DNA, 22 bp, Homo sapiens
caggctccagcttcctgctcag

SEQ ID NO: 10062427 - DNA, 22 bp, Homo sapiens
caggctcccgaaatcacccatg

SEQ ID NO: 10062428 - DNA, 22 bp, Homo sapiens
caggctcccaccctcctgcagc

SEQ ID NO: 10062429 - DNA, 22 bp, Homo sapiens
caggctcccacaagctcccagc

SEQ ID NO: 10062430 - DNA, 22 bp, Homo sapiens
cagggccaccctctgctgggtg

SEQ ID NO: 10062431 - DNA, 21 bp, Homo sapiens
cagggccaatcctgacctcta

SEQ ID NO: 10062432 - DNA, 22 bp, Homo sapiens
cagggccaagttggtgcctttt

SEQ ID NO: 10062433 - DNA, 20 bp, Homo sapiens
cagggccacgctccaaggca

SEQ ID NO: 10062434 - DNA, 22 bp, Homo sapiens
gagcccaggaagtggaggctga

SEQ ID NO: 10062435 - DNA, 22 bp, Homo sapiens
gagcccagattggaatttccca

SEQ ID NO: 10062436 - DNA, 22 bp, Homo sapiens
gagcccagctctacctcagact

SEQ ID NO: 10062437 - DNA, 22 bp, Homo sapiens
gagcccagctgcggccctcagc

SEQ ID NO: 10062438 - DNA, 22 bp, Homo sapiens
gaggagcccccactgggctcac

SEQ ID NO: 10062439 - DNA, 22 bp, Homo sapiens
gaccaggcccaggtgcaaggga

SEQ ID NO: 10062440 - DNA, 22 bp, Homo sapiens
gagaccccagctcagcctccag

SEQ ID NO: 10062441 - DNA, 22 bp, Homo sapiens
gacactggcttgtcccgccatc

SEQ ID NO: 10062442 - DNA, 22 bp, Homo sapiens
gacactggatttctagaaatgt

SEQ ID NO: 10062443 - DNA, 22 bp, Homo sapiens
ctgggatgtgaggagcgcctct

SEQ ID NO: 10062444 - DNA, 22 bp, Homo sapiens
ctgggcagctgtatcagggagt

SEQ ID NO: 10062445 - DNA, 22 bp, Homo sapiens
ctgggcagctaccaccactgct

SEQ ID NO: 10062446 - DNA, 22 bp, Homo sapiens
ctgggcagaattttaggatggc

SEQ ID NO: 10062447 - DNA, 22 bp, Homo sapiens
ctgggcagagctaacacctgag

SEQ ID NO: 10062448 - DNA, 22 bp, Homo sapiens
ctgggccttgatcacacaggtg

SEQ ID NO: 10062449 - DNA, 22 bp, Homo sapiens
ctgggacatagatcagcctttt

SEQ ID NO: 10062450 - DNA, 22 bp, Homo sapiens
ctgggaccagtgaagcaactca

SEQ ID NO: 10062451 - DNA, 22 bp, Homo sapiens
ctgggacatggtgctgtcttta

SEQ ID NO: 10062452 - DNA, 22 bp, Homo sapiens
ctgctgtgtggattcaatggct

SEQ ID NO: 10062453 - DNA, 23 bp, Homo sapiens
ctgctgtgttggtctcgatggga

SEQ ID NO: 10062454 - DNA, 20 bp, Homo sapiens
ctggggagctgctcccacga

SEQ ID NO: 10062455 - DNA, 22 bp, Homo sapiens
ctggggagaagcgactcggctg

SEQ ID NO: 10062456 - DNA, 23 bp, Homo sapiens
cttctcagaagtctgtgccagga

SEQ ID NO: 10062457 - DNA, 22 bp, Homo sapiens
cttccaggacaccagggtagta

SEQ ID NO: 10062458 - DNA, 19 bp, Homo sapiens
cttctggccctgagccacc

SEQ ID NO: 10062459 - DNA, 22 bp, Homo sapiens
cttctggcaaaacaggcagaaa

SEQ ID NO: 10062460 - DNA, 22 bp, Homo sapiens
cttctggcgttggaggtctgag

SEQ ID NO: 10062461 - DNA, 22 bp, Homo sapiens
ctgagcacctgctgtgtgccag

SEQ ID NO: 10062462 - DNA, 22 bp, Homo sapiens
ctgctccacaccgtccatactc

SEQ ID NO: 10062463 - DNA, 20 bp, Homo sapiens
ctgctccacccggctctcag

SEQ ID NO: 10062464 - DNA, 23 bp, Homo sapiens
ctgctccaggacagcatggaggt

SEQ ID NO: 10062465 - DNA, 22 bp, Homo sapiens
ctgcctgaactgggtgagcaag

SEQ ID NO: 10062466 - DNA, 22 bp, Homo sapiens
ctgcctgagtggaggtcgaggg

SEQ ID NO: 10062467 - DNA, 22 bp, Homo sapiens
ctgcctgcaggacacctcgcta

SEQ ID NO: 10062468 - DNA, 19 bp, Homo sapiens
ctgctgccggagactcgtc

SEQ ID NO: 10062469 - DNA, 22 bp, Homo sapiens
ctgctgccttccaaaggccagg

SEQ ID NO: 10062470 - DNA, 22 bp, Homo sapiens
ctgctgcctgattgcagacctc

SEQ ID NO: 10062471 - DNA, 22 bp, Homo sapiens
ctcctcagtcaggtctagggtc

SEQ ID NO: 10062472 - DNA, 19 bp, Homo sapiens
ctcctcagtcccagaggtc

SEQ ID NO: 10062473 - DNA, 21 bp, Homo sapiens
ctcaggctggcagcaggctag

SEQ ID NO: 10062474 - DNA, 22 bp, Homo sapiens
ctcaggctgccctgacagcccc

SEQ ID NO: 10062475 - DNA, 22 bp, Homo sapiens
ctcaggcttgggaggaggccca

SEQ ID NO: 10062476 - DNA, 22 bp, Homo sapiens
ctctgcttgtgtcaggcatgct

SEQ ID NO: 10062477 - DNA, 21 bp, Homo sapiens
ctctgctgtctaccagctgtt

SEQ ID NO: 10062478 - DNA, 22 bp, Homo sapiens
ctcagcccagcccaggaccagg

SEQ ID NO: 10062479 - DNA, 22 bp, Homo sapiens
ttcagggcgttgtggctgactg

SEQ ID NO: 10062480 - DNA, 22 bp, Homo sapiens
cggctggtgtcgggcacagcaa

SEQ ID NO: 10062481 - DNA, 22 bp, Homo sapiens
cggctgggttcggctgcaggcc

SEQ ID NO: 10062482 - DNA, 22 bp, Homo sapiens
cgggagcctctgggtcacactg

SEQ ID NO: 10062483 - DNA, 22 bp, Homo sapiens
cctggggagagaaagcccagcc

SEQ ID NO: 10062484 - DNA, 22 bp, Homo sapiens
tggttccactaacctgagagcc

SEQ ID NO: 10062485 - DNA, 22 bp, Homo sapiens
cctggggagaagagcttccccc

SEQ ID NO: 10062486 - DNA, 18 bp, Homo sapiens
cctgtcacgtccaggcct

SEQ ID NO: 10062487 - DNA, 22 bp, Homo sapiens
cctgtggaccaggaggcagccc

SEQ ID NO: 10062488 - DNA, 22 bp, Homo sapiens
cctgtggagctttcagcagctc

SEQ ID NO: 10062489 - DNA, 22 bp, Homo sapiens
ccttggggtgttggaggcagcc

SEQ ID NO: 10062490 - DNA, 22 bp, Homo sapiens
ccttgggaggctcccagggaga

SEQ ID NO: 10062491 - DNA, 22 bp, Homo sapiens
ccttgggatgcataagagccca

SEQ ID NO: 10062492 - DNA, 21 bp, Homo sapiens
ccttgggatgcaagtgagact

SEQ ID NO: 10062493 - DNA, 21 bp, Homo sapiens
taggacagcccccctgccctc

SEQ ID NO: 10062494 - DNA, 18 bp, Homo sapiens
taggttacagccagccag

SEQ ID NO: 10062495 - DNA, 23 bp, Homo sapiens
tagccaggcccagcatggacacc

SEQ ID NO: 10062496 - DNA, 22 bp, Homo sapiens
tagccaggcaattatgggtgat

SEQ ID NO: 10062497 - DNA, 22 bp, Homo sapiens
gttccaggtggtcacagagctc

SEQ ID NO: 10062498 - DNA, 22 bp, Homo sapiens
gtgtgtccttgggcctctgcag

SEQ ID NO: 10062499 - DNA, 22 bp, Homo sapiens
gtgtgtgtatctgcctatcaca

SEQ ID NO: 10062500 - DNA, 17 bp, Homo sapiens
tacaggagagcaggaac

SEQ ID NO: 10062501 - DNA, 22 bp, Homo sapiens
tacaggagagatttagtaatca

SEQ ID NO: 10062502 - DNA, 21 bp, Homo sapiens
tccaggccatggtggggaggc

SEQ ID NO: 10062503 - DNA, 22 bp, Homo sapiens
tccaggcccagacggggtgagg

SEQ ID NO: 10062504 - DNA, 22 bp, Homo sapiens
tccaggcccactcggtggggct

SEQ ID NO: 10062505 - DNA, 21 bp, Homo sapiens
tccaggcctcaggaagggatg

SEQ ID NO: 10062506 - DNA, 22 bp, Homo sapiens
tccaggccctgggatgggagca

SEQ ID NO: 10062507 - DNA, 22 bp, Homo sapiens
tccaggccgcaggggcagcccc

SEQ ID NO: 10062508 - DNA, 22 bp, Homo sapiens
tccaggagctcatccacgtcaa

SEQ ID NO: 10062509 - DNA, 22 bp, Homo sapiens
tccagcccgggggcaggtgacc

SEQ ID NO: 10062510 - DNA, 22 bp, Homo sapiens
tccagccctcagccaagtggaa

SEQ ID NO: 10062511 - DNA, 22 bp, Homo sapiens
tcccttcatcagtgagcaagcc

SEQ ID NO: 10062512 - DNA, 22 bp, Homo sapiens
tcctccctaaatcctagactgt

SEQ ID NO: 10062513 - DNA, 22 bp, Homo sapiens
tcagggcagcctaaggcacctc

SEQ ID NO: 10062514 - DNA, 22 bp, Homo sapiens
tcaggcctttcttcagagcttc

SEQ ID NO: 10062515 - DNA, 22 bp, Homo sapiens
tcagggcacaggcctgtgggtt

SEQ ID NO: 10062516 - DNA, 22 bp, Homo sapiens
tcaggagctcaggctgatggaa

SEQ ID NO: 10062517 - DNA, 22 bp, Homo sapiens
tcaggagctcttccctggtgtg

SEQ ID NO: 10062518 - DNA, 22 bp, Homo sapiens
tcaggagctgcactgggcccac

SEQ ID NO: 10062519 - DNA, 22 bp, Homo sapiens
tcaggagcttagatgctttgac

SEQ ID NO: 10062520 - DNA, 22 bp, Homo sapiens
tcaggagcttggtagtgtgatt

SEQ ID NO: 10062521 - DNA, 19 bp, Homo sapiens
tcaggagcagcttctgaac

SEQ ID NO: 10062522 - DNA, 22 bp, Homo sapiens
tcaggagcagggggaagctctg

SEQ ID NO: 10062523 - DNA, 22 bp, Homo sapiens
tcaggagctatggactgtcaaa

SEQ ID NO: 10062524 - DNA, 22 bp, Homo sapiens
tcaggagcctgaaagaggtcta

SEQ ID NO: 10062525 - DNA, 20 bp, Homo sapiens
tcaggagcctaggacatgat

SEQ ID NO: 10062526 - DNA, 22 bp, Homo sapiens
tcaggagcaggttgtttggttt

SEQ ID NO: 10062527 - DNA, 22 bp, Homo sapiens
tcaggagcatatattgatgtct

SEQ ID NO: 10062528 - DNA, 22 bp, Homo sapiens
tcaggagcagcatgggtgagag

SEQ ID NO: 10062529 - DNA, 22 bp, Homo sapiens
tcaggagcagccttggagagcg

SEQ ID NO: 10062530 - DNA, 22 bp, Homo sapiens
tcaggagcagctgtaggaaggg

SEQ ID NO: 10062531 - DNA, 22 bp, Homo sapiens
gcagggctaatggggcaagtag

SEQ ID NO: 10062532 - DNA, 22 bp, Homo sapiens
gcagggctaggtcttctagggc

SEQ ID NO: 10062533 - DNA, 22 bp, Homo sapiens
gcagggccttggtcatcttttt

SEQ ID NO: 10062534 - DNA, 22 bp, Homo sapiens
gcagggccttagcagcggctgc

SEQ ID NO: 10062535 - DNA, 22 bp, Homo sapiens
gcactgcctgtgagccctggtt

SEQ ID NO: 10062536 - DNA, 22 bp, Homo sapiens
gcactgccacataatctcagca

SEQ ID NO: 10062537 - DNA, 22 bp, Homo sapiens
gagggggagatgtgcacacact

SEQ ID NO: 10062538 - DNA, 22 bp, Homo sapiens
gagggggacgtatcctggtatg

SEQ ID NO: 10062539 - DNA, 22 bp, Homo sapiens
gagggggaaagtccctggagtc

SEQ ID NO: 10062540 - DNA, 22 bp, Homo sapiens
gccaggaccctggagggcatct

SEQ ID NO: 10062541 - DNA, 22 bp, Homo sapiens
gccaggacggtgaatgggctac

SEQ ID NO: 10062542 - DNA, 22 bp, Homo sapiens
gcccagggctgcaagtggacgc

SEQ ID NO: 10062543 - DNA, 22 bp, Homo sapiens
gcccaggggagtagtcaattta

SEQ ID NO: 10062544 - DNA, 22 bp, Homo sapiens
gcccagtggtaaaagcaggcct

SEQ ID NO: 10062545 - DNA, 20 bp, Homo sapiens
gcctcagccaacccatgggg

SEQ ID NO: 10062546 - DNA, 22 bp, Homo sapiens
gccagagcacaggctggtagta

SEQ ID NO: 10062547 - DNA, 22 bp, Homo sapiens
gccagagcagaatagagtggcc

SEQ ID NO: 10062548 - DNA, 22 bp, Homo sapiens
gccagagcatcgcaccctccat

SEQ ID NO: 10062549 - DNA, 22 bp, Homo sapiens
gccagagccacttttgggtgat

SEQ ID NO: 10062550 - DNA, 22 bp, Homo sapiens
gccagagcatgcactgcctgca

SEQ ID NO: 10062551 - DNA, 22 bp, Homo sapiens
gccagagccggcttcacaggat

SEQ ID NO: 10062552 - DNA, 21 bp, Homo sapiens
gccagccatgcttgcctaggc

SEQ ID NO: 10062553 - DNA, 22 bp, Homo sapiens
gccagccccttagggctctccc

SEQ ID NO: 10062554 - DNA, 22 bp, Homo sapiens
gccagagcttcccccgagtgtg

SEQ ID NO: 10062555 - DNA, 22 bp, Homo sapiens
gcagggctccccaggcccgagg

SEQ ID NO: 10062556 - DNA, 22 bp, Homo sapiens
gcagggctctgctgtagtccta

SEQ ID NO: 10062557 - DNA, 22 bp, Homo sapiens
gcagggctcagccgctcccacc

SEQ ID NO: 10062558 - DNA, 22 bp, Homo sapiens
gctgccagctgcggcccacgcg

SEQ ID NO: 10062559 - DNA, 22 bp, Homo sapiens
gctgccaggccctggggctatg

SEQ ID NO: 10062560 - DNA, 22 bp, Homo sapiens
gctctccactgaccacggggca

SEQ ID NO: 10062561 - DNA, 21 bp, Homo sapiens
gctctccagggccagcccagg

SEQ ID NO: 10062562 - DNA, 22 bp, Homo sapiens
gctcaggcctggcccatgggac

SEQ ID NO: 10062563 - DNA, 22 bp, Homo sapiens
gctcaggcctccagaggggcaa

SEQ ID NO: 10062564 - DNA, 22 bp, Homo sapiens
gcctggggtctctgactcacag

SEQ ID NO: 10062565 - DNA, 22 bp, Homo sapiens
gcctggtgtccagaggcgagtg

SEQ ID NO: 10062566 - DNA, 22 bp, Homo sapiens
gccttcaggtgctgccaggcta

SEQ ID NO: 10062567 - DNA, 22 bp, Homo sapiens
gcctggctgcttagcctacttc

SEQ ID NO: 10062568 - DNA, 22 bp, Homo sapiens
gcctcaggccgccctgctgctc

SEQ ID NO: 10062569 - DNA, 22 bp, Homo sapiens
gcctcagggataggatgagcat

SEQ ID NO: 10062570 - DNA, 22 bp, Homo sapiens
gcctggctggtagagggggctc

SEQ ID NO: 10062571 - DNA, 22 bp, Homo sapiens
gcctggggaacttgatcctgtc

SEQ ID NO: 10062572 - DNA, 23 bp, Homo sapiens
gcctggcttccaaggtaggggag

SEQ ID NO: 10062573 - DNA, 22 bp, Homo sapiens
gccttccacctaggcctctgct

SEQ ID NO: 10062574 - DNA, 22 bp, Homo sapiens
gctgtgcagccaagtgcctctg

SEQ ID NO: 10062575 - DNA, 22 bp, Homo sapiens
gctgtgcaggtccccactgcct

SEQ ID NO: 10062576 - DNA, 19 bp, Homo sapiens
gctgtgaaagcagccatat

SEQ ID NO: 10062577 - DNA, 22 bp, Homo sapiens
gctgtgagaaacagggagtgtc

SEQ ID NO: 10062578 - DNA, 22 bp, Homo sapiens
gctgccatggtccaggctccag

SEQ ID NO: 10062579 - DNA, 22 bp, Homo sapiens
gctgggactgagacagtgacct

SEQ ID NO: 10062580 - DNA, 22 bp, Homo sapiens
gctgggaagagatgcacatgat

SEQ ID NO: 10062581 - DNA, 22 bp, Homo sapiens
gctgggacaggcttggccctgt

SEQ ID NO: 10062582 - DNA, 22 bp, Homo sapiens
ggctggagacaacgtcctgccc

SEQ ID NO: 10062583 - DNA, 22 bp, Homo sapiens
ggctgagggtatagctgtccca

SEQ ID NO: 10062584 - DNA, 22 bp, Homo sapiens
gggagctggagctggaagactc

SEQ ID NO: 10062585 - DNA, 22 bp, Homo sapiens
ggctgtgcctctggcagcacat

SEQ ID NO: 10062586 - DNA, 22 bp, Homo sapiens
ggagatggccacgtcactcagt

SEQ ID NO: 10062587 - DNA, 22 bp, Homo sapiens
ggccaggcgatgacccctccac

SEQ ID NO: 10062588 - DNA, 22 bp, Homo sapiens
ggccaggccaagagggttggaa

SEQ ID NO: 10062589 - DNA, 22 bp, Homo sapiens
ggccaggagcaagccaggctct

SEQ ID NO: 10062590 - DNA, 19 bp, Homo sapiens
ggcctggctatccctgctg

SEQ ID NO: 10062591 - DNA, 22 bp, Homo sapiens
ggcctggcctcccttcctagcg

SEQ ID NO: 10062592 - DNA, 22 bp, Homo sapiens
ggcctggctcttgcccagcctg

SEQ ID NO: 10062593 - DNA, 22 bp, Homo sapiens
ggcctggctggttcagtaccct

SEQ ID NO: 10062594 - DNA, 23 bp, Homo sapiens
ggcctggcccagggccctgatga

SEQ ID NO: 10062595 - DNA, 22 bp, Homo sapiens
ggcctggcagagcgcgcggctg

SEQ ID NO: 10062596 - DNA, 22 bp, Homo sapiens
ggcctcagaccggagctggcca

SEQ ID NO: 10062597 - DNA, 22 bp, Homo sapiens
gggtccagagcctcagcccaga

SEQ ID NO: 10062598 - DNA, 21 bp, Homo sapiens
ggtcagggggtgcctccaggt

SEQ ID NO: 10062599 - DNA, 22 bp, Homo sapiens
ggtcaggggctgctctacagag

SEQ ID NO: 10062600 - DNA, 22 bp, Homo sapiens
ggtcagggctcttccagtggct

SEQ ID NO: 10062601 - DNA, 22 bp, Homo sapiens
gggcctccgtgtgctggtgctc

SEQ ID NO: 10062602 - DNA, 22 bp, Homo sapiens
gggcctccggggtgagctgtgg

SEQ ID NO: 10062603 - DNA, 22 bp, Homo sapiens
gggctgggaatggctaagtatg

SEQ ID NO: 10062604 - DNA, 22 bp, Homo sapiens
gggctgggatggcttgaagatt

SEQ ID NO: 10062605 - DNA, 22 bp, Homo sapiens
gggctggggctcaataatttgt

SEQ ID NO: 10062606 - DNA, 22 bp, Homo sapiens
gggctgggattgcttgctgtga

SEQ ID NO: 10062607 - DNA, 22 bp, Homo sapiens
gggctgggcatggtgttccctc

SEQ ID NO: 10062608 - DNA, 22 bp, Homo sapiens
ggggcagaagtagtgcccctga

SEQ ID NO: 10062609 - DNA, 22 bp, Homo sapiens
gtgcctccaggctcgactagtc

SEQ ID NO: 10062610 - DNA, 22 bp, Homo sapiens
gtgcctccctgttgactagggt

SEQ ID NO: 10062611 - DNA, 22 bp, Homo sapiens
gtgctgggccctgagaccaggg

SEQ ID NO: 10062612 - DNA, 23 bp, Homo sapiens
gtcagggcagctcccagcccaac

SEQ ID NO: 10062613 - DNA, 23 bp, Homo sapiens
gtcagggctggggtcagagtgac

SEQ ID NO: 10062614 - DNA, 22 bp, Homo sapiens
ttgttcaggcctgggacagttt

SEQ ID NO: 10062615 - DNA, 22 bp, Homo sapiens
ttgctcagctgtgagatatcca

SEQ ID NO: 10062616 - DNA, 22 bp, Homo sapiens
ttgctcaggcttagagctacta

SEQ ID NO: 10062617 - DNA, 22 bp, Homo sapiens
ttgcttcatcagagtaaacaag

SEQ ID NO: 10062618 - DNA, 22 bp, Homo sapiens
ttgcctcccagcatgggcagct

SEQ ID NO: 10062619 - DNA, 22 bp, Homo sapiens
ttgcctccttttaaggaaatca

SEQ ID NO: 10062620 - DNA, 22 bp, Homo sapiens
ttgcctggtcctgtgggtgctg

SEQ ID NO: 10062621 - DNA, 22 bp, Homo sapiens
ttgcctggattctaccacagaa

SEQ ID NO: 10062622 - DNA, 22 bp, Homo sapiens
ttgcctggatggtccccagaga

SEQ ID NO: 10062623 - DNA, 22 bp, Homo sapiens
ttgcctggactctgctggtatt

SEQ ID NO: 10062624 - DNA, 22 bp, Homo sapiens
ttgccagggctttggtggcatc

SEQ ID NO: 10062625 - DNA, 22 bp, Homo sapiens
ttgccagggtcaggatgagatc

SEQ ID NO: 10062626 - DNA, 22 bp, Homo sapiens
ttgccaggagacaaagtgggcc

SEQ ID NO: 10062627 - DNA, 22 bp, Homo sapiens
ttgccagggaacagggagaggc

SEQ ID NO: 10062628 - DNA, 22 bp, Homo sapiens
ttctcctcactgcagcctttca

SEQ ID NO: 10062629 - DNA, 17 bp, Homo sapiens
ttctcttcctggatagt

SEQ ID NO: 10062630 - DNA, 22 bp, Homo sapiens
ttatggaatttgcaaaaggtta

SEQ ID NO: 10062631 - DNA, 22 bp, Homo sapiens
tcctctgctggaagggcaagag

SEQ ID NO: 10062632 - DNA, 19 bp, Homo sapiens
ttcccctccccagggatag

SEQ ID NO: 10062633 - DNA, 22 bp, Homo sapiens
actagggctcaggcctacctag

SEQ ID NO: 10062634 - DNA, 22 bp, Homo sapiens
aggtctcccaagggccagggag

SEQ ID NO: 10062635 - DNA, 22 bp, Homo sapiens
agggcagcagctcctcctagct

SEQ ID NO: 10062636 - DNA, 22 bp, Homo sapiens
accaggcctggctgggcagcca

SEQ ID NO: 10062637 - DNA, 22 bp, Homo sapiens
agggcagcagcccatggctctg

SEQ ID NO: 10062638 - DNA, 21 bp, Homo sapiens
aggcctcttcatggccatgat

SEQ ID NO: 10062639 - DNA, 22 bp, Homo sapiens
aggcctctgggtctcctctgac

SEQ ID NO: 10062640 - DNA, 22 bp, Homo sapiens
acagctgggaactcacacagca

SEQ ID NO: 10062641 - DNA, 22 bp, Homo sapiens
aggaagaatgtttacatatcaa

SEQ ID NO: 10062642 - DNA, 22 bp, Homo sapiens
acagtgtgtgggaaatgtgact

SEQ ID NO: 10062643 - DNA, 22 bp, Homo sapiens
acagtgtgacaattgtgtcaga

SEQ ID NO: 10062644 - DNA, 22 bp, Homo sapiens
aggagcactaattcctgcagag

SEQ ID NO: 10062645 - DNA, 22 bp, Homo sapiens
aggagcagaccgtagtcctgca

SEQ ID NO: 10062646 - DNA, 22 bp, Homo sapiens
agcctccctatgcaccttcagg

SEQ ID NO: 10062647 - DNA, 22 bp, Homo sapiens
agcctggagttcccaggagaag

SEQ ID NO: 10062648 - DNA, 22 bp, Homo sapiens
agcctgactaataggagttgag

SEQ ID NO: 10062649 - DNA, 22 bp, Homo sapiens
cagcagctcactcaggtggctc

SEQ ID NO: 10062650 - DNA, 22 bp, Homo sapiens
agcctgagctgcctgccgcctc

SEQ ID NO: 10062651 - DNA, 22 bp, Homo sapiens
cagcagctccaaagaatagcca

SEQ ID NO: 10062652 - DNA, 22 bp, Homo sapiens
agctcaggcaactctgggcccc

SEQ ID NO: 10062653 - DNA, 22 bp, Homo sapiens
cacccagggctgtgcctgccca

SEQ ID NO: 10062654 - DNA, 23 bp, Homo sapiens
cactgccttcagttgcttcacct

SEQ ID NO: 10062655 - DNA, 22 bp, Homo sapiens
agcagctgctccacttgcttaa

SEQ ID NO: 10062656 - DNA, 22 bp, Homo sapiens
agcagctgatggggaaggagtt

SEQ ID NO: 10062657 - DNA, 22 bp, Homo sapiens
agcagctgatcaaagcacttat

SEQ ID NO: 10062658 - DNA, 22 bp, Homo sapiens
agcagccacccagctgctcatt

SEQ ID NO: 10062659 - DNA, 23 bp, Homo sapiens
agacccagagactggctctgctc

SEQ ID NO: 10062660 - DNA, 22 bp, Homo sapiens
agaccagggtcccacagagtct

SEQ ID NO: 10062661 - DNA, 22 bp, Homo sapiens
agagccacggcaggcctaggaa

SEQ ID NO: 10062662 - DNA, 22 bp, Homo sapiens
agagccagatggagccgtgtgt

SEQ ID NO: 10062663 - DNA, 22 bp, Homo sapiens
agagccagaccattgccgtgca

SEQ ID NO: 10062664 - DNA, 22 bp, Homo sapiens
agagcctggtctgagataggac

SEQ ID NO: 10062665 - DNA, 22 bp, Homo sapiens
agagcctgtgggagatgcagct

SEQ ID NO: 10062666 - DNA, 22 bp, Homo sapiens
agagcctgttcggaggcgcccc

SEQ ID NO: 10062667 - DNA, 22 bp, Homo sapiens
agagccagcaactctagccctg

SEQ ID NO: 10062668 - DNA, 22 bp, Homo sapiens
agagcctgggcagctcctctgg

SEQ ID NO: 10062669 - DNA, 22 bp, Homo sapiens
agagcctgggaatttgcatgtt

SEQ ID NO: 10062670 - DNA, 22 bp, Homo sapiens
agagcctgcagtggagaccttg

SEQ ID NO: 10062671 - DNA, 22 bp, Homo sapiens
attgcctgccactctgtgagga

SEQ ID NO: 10062672 - DNA, 21 bp, Homo sapiens
agaggccttacaggatagacc

SEQ ID NO: 10062673 - DNA, 22 bp, Homo sapiens
attccaggattccaggacaaat

SEQ ID NO: 10062674 - DNA, 22 bp, Homo sapiens
attccaggcaaagcagagaaga

SEQ ID NO: 10062675 - DNA, 23 bp, Homo sapiens
attccaggaaatacttggctttc

SEQ ID NO: 10062676 - DNA, 22 bp, Homo sapiens
attccaggaagtgtgggaccaa

SEQ ID NO: 10062677 - DNA, 22 bp, Homo sapiens
attccaggagctaactgtggtc

SEQ ID NO: 10062678 - DNA, 22 bp, Homo sapiens
aaccaccattctctcctcttcc

SEQ ID NO: 10062679 - DNA, 20 bp, Homo sapiens
aacagggggctgcagagggc

SEQ ID NO: 10062680 - DNA, 22 bp, Homo sapiens
aatataatgctgttttatgcca

SEQ ID NO: 10062681 - DNA, 22 bp, Homo sapiens
aagattgttttggatgctaact

SEQ ID NO: 10062682 - DNA, 22 bp, Homo sapiens
acactggataccactgttatta

SEQ ID NO: 10062683 - DNA, 22 bp, Homo sapiens
aaataggaatgtggtcctggga

SEQ ID NO: 10062684 - DNA, 23 bp, Homo sapiens
aaataggagtatctggatcatga

SEQ ID NO: 10062685 - DNA, 22 bp, Homo sapiens
agccatgggctcccagtccttt

SEQ ID NO: 10062686 - DNA, 22 bp, Homo sapiens
agaggccccaggtgagcatgcc

SEQ ID NO: 10062687 - DNA, 22 bp, Homo sapiens
actgcctgtttggcatggcccc

SEQ ID NO: 10062688 - DNA, 22 bp, Homo sapiens
accccaggagctgtgcctagtc

SEQ ID NO: 10062689 - DNA, 22 bp, Homo sapiens
accccagggctgccagcctcct

SEQ ID NO: 10062690 - DNA, 22 bp, Homo sapiens
gagccccaggacagctctagtt

SEQ ID NO: 10062691 - DNA, 22 bp, Homo sapiens
gaggttccccattgtactggct

SEQ ID NO: 10062692 - DNA, 22 bp, Homo sapiens
gaagccttgaactgcaaacccc

SEQ ID NO: 10062693 - DNA, 22 bp, Homo sapiens
gaagcctttgcctaaaacatta

SEQ ID NO: 10062694 - DNA, 20 bp, Homo sapiens
gcagggcatcttggccccca

SEQ ID NO: 10062695 - DNA, 18 bp, Homo sapiens
gccagccaggcgttgctc

SEQ ID NO: 10062696 - DNA, 19 bp, Homo sapiens
gcccaggggcccgatgctg

SEQ ID NO: 10062697 - DNA, 22 bp, Homo sapiens
gcccagggtgaagtgcagttgt

SEQ ID NO: 10062698 - DNA, 22 bp, Homo sapiens
gccatggcccataccaggtgca

SEQ ID NO: 10062699 - DNA, 22 bp, Homo sapiens
gccatgcctgtgtctccaggcc

SEQ ID NO: 10062700 - DNA, 20 bp, Homo sapiens
gccttccagttcagtggcac

SEQ ID NO: 10062701 - DNA, 22 bp, Homo sapiens
gctgcctgccctgggtcatctg

SEQ ID NO: 10062702 - DNA, 22 bp, Homo sapiens
gctgcctgcctagttccacagt

SEQ ID NO: 10062703 - DNA, 22 bp, Homo sapiens
gctgcctgcctgcatttaatcc

SEQ ID NO: 10062704 - DNA, 22 bp, Homo sapiens
gctgcctgccttgcctggagga

SEQ ID NO: 10062705 - DNA, 22 bp, Homo sapiens
gctgcctgcagtgttttcccag

SEQ ID NO: 10062706 - DNA, 18 bp, Homo sapiens
gctgcctgcattcctcac

SEQ ID NO: 10062707 - DNA, 21 bp, Homo sapiens
gctgcctgcccctcgggggct

SEQ ID NO: 10062708 - DNA, 22 bp, Homo sapiens
gctgcctgatttacatagtgaa

SEQ ID NO: 10062709 - DNA, 17 bp, Homo sapiens
gctgcctgcaactgact

SEQ ID NO: 10062710 - DNA, 22 bp, Homo sapiens
gctgcctgcacagagctgcttt

SEQ ID NO: 10062711 - DNA, 22 bp, Homo sapiens
caaggccttgctgtctcctcct

SEQ ID NO: 10062712 - DNA, 22 bp, Homo sapiens
ggagagcagggtcctgagatac

SEQ ID NO: 10062713 - DNA, 22 bp, Homo sapiens
ggaagctgaggcccagtgaagg

SEQ ID NO: 10062714 - DNA, 22 bp, Homo sapiens
cacctgccctttcttgctccac

SEQ ID NO: 10062715 - DNA, 22 bp, Homo sapiens
cacctgcctgcaggggctccac

SEQ ID NO: 10062716 - DNA, 22 bp, Homo sapiens
cacctggatatgtttcagcttg

SEQ ID NO: 10062717 - DNA, 22 bp, Homo sapiens
cacctggagtagcaaggtaatt

SEQ ID NO: 10062718 - DNA, 22 bp, Homo sapiens
ggccaggctggtctcagacttc

SEQ ID NO: 10062719 - DNA, 22 bp, Homo sapiens
ggccaggctggttccttgacct

SEQ ID NO: 10062720 - DNA, 22 bp, Homo sapiens
ggccaggctgccctgggagcag

SEQ ID NO: 10062721 - DNA, 22 bp, Homo sapiens
ggccaggctgctgggaccccgc

SEQ ID NO: 10062722 - DNA, 22 bp, Homo sapiens
cacagggcaggtactctcagag

SEQ ID NO: 10062723 - DNA, 18 bp, Homo sapiens
cacaggagccacactcac

SEQ ID NO: 10062724 - DNA, 22 bp, Homo sapiens
ggagagcctccacggcttctgt

SEQ ID NO: 10062725 - DNA, 22 bp, Homo sapiens
cagcagccactagagggctcac

SEQ ID NO: 10062726 - DNA, 22 bp, Homo sapiens
cagcagcctacaatgcacagaa

SEQ ID NO: 10062727 - DNA, 20 bp, Homo sapiens
gtccagagtaatgtgctgac

SEQ ID NO: 10062728 - DNA, 22 bp, Homo sapiens
gtccagagaggcaggaggctac

SEQ ID NO: 10062729 - DNA, 22 bp, Homo sapiens
gtccagagatggacgagcagat

SEQ ID NO: 10062730 - DNA, 22 bp, Homo sapiens
cagccaggagctccccctgctc

SEQ ID NO: 10062731 - DNA, 22 bp, Homo sapiens
cagccaggagcctctgcaacta

SEQ ID NO: 10062732 - DNA, 22 bp, Homo sapiens
cagccaggcccccgagtcgttg

SEQ ID NO: 10062733 - DNA, 22 bp, Homo sapiens
cagccaggatggagaactgttg

SEQ ID NO: 10062734 - DNA, 22 bp, Homo sapiens
cagccaggcccagatcatgctg

SEQ ID NO: 10062735 - DNA, 22 bp, Homo sapiens
cagccctcatctcagcttcttt

SEQ ID NO: 10062736 - DNA, 20 bp, Homo sapiens
cagccctccagtggaggcag

SEQ ID NO: 10062737 - DNA, 22 bp, Homo sapiens
cagccctcctaccctgccaggc

SEQ ID NO: 10062738 - DNA, 22 bp, Homo sapiens
cagccctctgaagaggcgcttg

SEQ ID NO: 10062739 - DNA, 22 bp, Homo sapiens
gggtacagttcttccagtgtca

SEQ ID NO: 10062740 - DNA, 22 bp, Homo sapiens
ggggcagatggaacagagcaca

SEQ ID NO: 10062741 - DNA, 21 bp, Homo sapiens
ggggcagagctaggccctgca

SEQ ID NO: 10062742 - DNA, 22 bp, Homo sapiens
gggctgtgtaatgtgctctttt

SEQ ID NO: 10062743 - DNA, 20 bp, Homo sapiens
gggctgtgcctcctcgtggt

SEQ ID NO: 10062744 - DNA, 22 bp, Homo sapiens
cagagccagcagtggggacagg

SEQ ID NO: 10062745 - DNA, 22 bp, Homo sapiens
cagagccagcccactgttcccg

SEQ ID NO: 10062746 - DNA, 22 bp, Homo sapiens
cagagccactgtctgccaggca

SEQ ID NO: 10062747 - DNA, 18 bp, Homo sapiens
cagacactctgctctgca

SEQ ID NO: 10062748 - DNA, 22 bp, Homo sapiens
cagagacaatgtctctgcttgt

SEQ ID NO: 10062749 - DNA, 22 bp, Homo sapiens
cagagcacctgctcattgccag

SEQ ID NO: 10062750 - DNA, 22 bp, Homo sapiens
cagagccaacgccacctgccca

SEQ ID NO: 10062751 - DNA, 22 bp, Homo sapiens
cagagccacagcctccagattt

SEQ ID NO: 10062752 - DNA, 22 bp, Homo sapiens
cagagccaaacctcagggcccg

SEQ ID NO: 10062753 - DNA, 22 bp, Homo sapiens
aggattgtgcctccagtcagaa

SEQ ID NO: 10062754 - DNA, 20 bp, Homo sapiens
cagtgcctgccccttgggtt

SEQ ID NO: 10062755 - DNA, 22 bp, Homo sapiens
agctgggcttggccaggtcgct

SEQ ID NO: 10062756 - DNA, 22 bp, Homo sapiens
caggtcctttagtgtccagaac

SEQ ID NO: 10062757 - DNA, 22 bp, Homo sapiens
cagggtgactgccctggccact

SEQ ID NO: 10062758 - DNA, 22 bp, Homo sapiens
cagggcctctcatcccacgggc

SEQ ID NO: 10062759 - DNA, 22 bp, Homo sapiens
cagggcctcgaagcctctgggc

SEQ ID NO: 10062760 - DNA, 22 bp, Homo sapiens
cagggcctctgtgggctctctc

SEQ ID NO: 10062761 - DNA, 22 bp, Homo sapiens
cagggcctgagggctgctctgc

SEQ ID NO: 10062762 - DNA, 22 bp, Homo sapiens
cagggctcccaaatatctcttc

SEQ ID NO: 10062763 - DNA, 22 bp, Homo sapiens
cagggctccccagagagcctct

SEQ ID NO: 10062764 - DNA, 22 bp, Homo sapiens
cagggctccctgcagcctctgt

SEQ ID NO: 10062765 - DNA, 22 bp, Homo sapiens
cagggctcgctgccagcttcag

SEQ ID NO: 10062766 - DNA, 22 bp, Homo sapiens
cagggctcgctcttgcccttcg

SEQ ID NO: 10062767 - DNA, 22 bp, Homo sapiens
caggctccactgtaggcagctc

SEQ ID NO: 10062768 - DNA, 22 bp, Homo sapiens
caggctcagatgccctgcgctg

SEQ ID NO: 10062769 - DNA, 22 bp, Homo sapiens
ccagcctccatgtagatagctg

SEQ ID NO: 10062770 - DNA, 22 bp, Homo sapiens
ccaggagagcagaagcccaggc

SEQ ID NO: 10062771 - DNA, 22 bp, Homo sapiens
ccaggagagcattgcacagagg

SEQ ID NO: 10062772 - DNA, 22 bp, Homo sapiens
ccaggagagcgccctcccggcc

SEQ ID NO: 10062773 - DNA, 22 bp, Homo sapiens
ccaggagatttttccatagcac

SEQ ID NO: 10062774 - DNA, 21 bp, Homo sapiens
cccagagcctagggagggcac

SEQ ID NO: 10062775 - DNA, 22 bp, Homo sapiens
cccagagcatgtgctgcctttg

SEQ ID NO: 10062776 - DNA, 22 bp, Homo sapiens
cccagagccgctcccctacttc

SEQ ID NO: 10062777 - DNA, 22 bp, Homo sapiens
ccatgggacctacctcctgtgc

SEQ ID NO: 10062778 - DNA, 22 bp, Homo sapiens
aggctccaaattaccaagctct

SEQ ID NO: 10062779 - DNA, 22 bp, Homo sapiens
aggctccaccctacagagctcc

SEQ ID NO: 10062780 - DNA, 22 bp, Homo sapiens
ccaggagctggcatgtggagag

SEQ ID NO: 10062781 - DNA, 22 bp, Homo sapiens
ccaggagctggagggtgcagtg

SEQ ID NO: 10062782 - DNA, 22 bp, Homo sapiens
ccagggtgaccagctggcctag

SEQ ID NO: 10062783 - DNA, 22 bp, Homo sapiens
aggctcctgcaggtgaggtgct

SEQ ID NO: 10062784 - DNA, 22 bp, Homo sapiens
aggctcctgatcctggggtctg

SEQ ID NO: 10062785 - DNA, 22 bp, Homo sapiens
aggctccttgctcacaggctca

SEQ ID NO: 10062786 - DNA, 22 bp, Homo sapiens
aggctcctagcctgtggctggt

SEQ ID NO: 10062787 - DNA, 20 bp, Homo sapiens
aggctcctccaggatgtgtg

SEQ ID NO: 10062788 - DNA, 16 bp, Homo sapiens
agggccagaagcatca

SEQ ID NO: 10062789 - DNA, 22 bp, Homo sapiens
agggccagagtctgtgtagata

SEQ ID NO: 10062790 - DNA, 22 bp, Homo sapiens
agggccagaatccctcagtcta

SEQ ID NO: 10062791 - DNA, 22 bp, Homo sapiens
agggccagaggcaccttgcagc

SEQ ID NO: 10062792 - DNA, 22 bp, Homo sapiens
cctgaggccctggctgtgctga

SEQ ID NO: 10062793 - DNA, 22 bp, Homo sapiens
ccctctctcggttgctgtggtt

SEQ ID NO: 10062794 - DNA, 22 bp, Homo sapiens
ccctctcttagaagaaacacag

SEQ ID NO: 10062795 - DNA, 22 bp, Homo sapiens
ccctctctgctgcatagaggaa

SEQ ID NO: 10062796 - DNA, 22 bp, Homo sapiens
ccctctctgacttctgaacttg

SEQ ID NO: 10062797 - DNA, 22 bp, Homo sapiens
ccctctctctatcgggccccag

SEQ ID NO: 10062798 - DNA, 22 bp, Homo sapiens
ccctctgctcaggtgcataggc

SEQ ID NO: 10062799 - DNA, 22 bp, Homo sapiens
cccagggcttttctcactagac

SEQ ID NO: 10062800 - DNA, 22 bp, Homo sapiens
cccagggctgtagaatgtccaa

SEQ ID NO: 10062801 - DNA, 22 bp, Homo sapiens
cccagggcttgagtcatccatg

SEQ ID NO: 10062802 - DNA, 22 bp, Homo sapiens
cctgggcaggtgtggcttcccc

SEQ ID NO: 10062803 - DNA, 22 bp, Homo sapiens
cctgggcagggctggactctca

SEQ ID NO: 10062804 - DNA, 22 bp, Homo sapiens
cctgggcagggagaccaggctc

SEQ ID NO: 10062805 - DNA, 22 bp, Homo sapiens
cctgggcaggccggacgctggg

SEQ ID NO: 10062806 - DNA, 22 bp, Homo sapiens
cctgcctgcgtcctctgagggc

SEQ ID NO: 10062807 - DNA, 22 bp, Homo sapiens
cctgcctgcggcccgcggggag

SEQ ID NO: 10062808 - DNA, 22 bp, Homo sapiens
cctgcctggctgtcagcagagc

SEQ ID NO: 10062809 - DNA, 22 bp, Homo sapiens
cctgcctggcccaccttgccac

SEQ ID NO: 10062810 - DNA, 22 bp, Homo sapiens
cctggccagccagggctggggt

SEQ ID NO: 10062811 - DNA, 22 bp, Homo sapiens
cctggccagcagccccttcctc

SEQ ID NO: 10062812 - DNA, 22 bp, Homo sapiens
cgcctgggagtccacacctgct

SEQ ID NO: 10062813 - DNA, 22 bp, Homo sapiens
cgtgattggcttctgcattgga

SEQ ID NO: 10062814 - DNA, 22 bp, Homo sapiens
cctggtgaatgttcatggactg

SEQ ID NO: 10062815 - DNA, 22 bp, Homo sapiens
ctcctcagctgggaggagtccc

SEQ ID NO: 10062816 - DNA, 22 bp, Homo sapiens
ctcccaggggagtcatctgctt

SEQ ID NO: 10062817 - DNA, 22 bp, Homo sapiens
ctcctctcaggctggatggcgc

SEQ ID NO: 10062818 - DNA, 22 bp, Homo sapiens
ctcctctccatcagcgccaccc

SEQ ID NO: 10062819 - DNA, 22 bp, Homo sapiens
ctcctctcaaaagtaggttgac

SEQ ID NO: 10062820 - DNA, 22 bp, Homo sapiens
ctggggaggcagggctgcccct

SEQ ID NO: 10062821 - DNA, 21 bp, Homo sapiens
ctgtccacatcacagagcctc

SEQ ID NO: 10062822 - DNA, 22 bp, Homo sapiens
ctgtccagctgaccagagcagc

SEQ ID NO: 10062823 - DNA, 17 bp, Homo sapiens
ctgggcctctgcccttt

SEQ ID NO: 10062824 - DNA, 21 bp, Homo sapiens
ctgtccagtaattcctggcac

SEQ ID NO: 10062825 - DNA, 22 bp, Homo sapiens
ctgtgcctggggggcagagctg

SEQ ID NO: 10062826 - DNA, 22 bp, Homo sapiens
ctggccaggcttgggacagaca

SEQ ID NO: 10062827 - DNA, 22 bp, Homo sapiens
ctggccagtgcctgtgggcccc

SEQ ID NO: 10062828 - DNA, 18 bp, Homo sapiens
ctgcctgctctccagctt

SEQ ID NO: 10062829 - DNA, 22 bp, Homo sapiens
ctgccctctagaggaggactga

SEQ ID NO: 10062830 - DNA, 22 bp, Homo sapiens
tcctcaggatctaggagtgctt

SEQ ID NO: 10062831 - DNA, 22 bp, Homo sapiens
tcctcaggcggtgaggaggggc

SEQ ID NO: 10062832 - DNA, 22 bp, Homo sapiens
tccagaccatgtgagaggcgca

SEQ ID NO: 10062833 - DNA, 20 bp, Homo sapiens
tccaggctcctccacttagt

SEQ ID NO: 10062834 - DNA, 22 bp, Homo sapiens
tccaggcccctgcctgggcctg

SEQ ID NO: 10062835 - DNA, 22 bp, Homo sapiens
tccaggcccgagatgggctgga

SEQ ID NO: 10062836 - DNA, 22 bp, Homo sapiens
tccaggctcagtcaagcacttc

SEQ ID NO: 10062837 - DNA, 22 bp, Homo sapiens
tccaggccccagcaccttggga

SEQ ID NO: 10062838 - DNA, 22 bp, Homo sapiens
tccaggcccatggagcagagct

SEQ ID NO: 10062839 - DNA, 20 bp, Homo sapiens
tccagctgggaacagctgat

SEQ ID NO: 10062840 - DNA, 22 bp, Homo sapiens
ccacccttgggttcggaggccg

SEQ ID NO: 10062841 - DNA, 22 bp, Homo sapiens
ccacattcaccagctgcacgac

SEQ ID NO: 10062842 - DNA, 22 bp, Homo sapiens
tcctctctgcactggccctgcc

SEQ ID NO: 10062843 - DNA, 18 bp, Homo sapiens
tcctctctttccccaggg

SEQ ID NO: 10062844 - DNA, 21 bp, Homo sapiens
tcctctgcagtgaggtggcct

SEQ ID NO: 10062845 - DNA, 22 bp, Homo sapiens
ccacctcctcggccatgtgacg

SEQ ID NO: 10062846 - DNA, 22 bp, Homo sapiens
ccagccctgcctctcagggccc

SEQ ID NO: 10062847 - DNA, 22 bp, Homo sapiens
ccagccctgtttatgtgtcact

SEQ ID NO: 10062848 - DNA, 22 bp, Homo sapiens
ccagccctgtaaggatgaggca

SEQ ID NO: 10062849 - DNA, 23 bp, Homo sapiens
tcagcagcagaagtgctgggatg

SEQ ID NO: 10062850 - DNA, 22 bp, Homo sapiens
cagtgggacatgggcactgggc

SEQ ID NO: 10062851 - DNA, 22 bp, Homo sapiens
cagtgggagcaaatacactcat

SEQ ID NO: 10062852 - DNA, 22 bp, Homo sapiens
cagtgggattgggattggaacc

SEQ ID NO: 10062853 - DNA, 22 bp, Homo sapiens
tcacaacaggaaggaccagctg

SEQ ID NO: 10062854 - DNA, 22 bp, Homo sapiens
cagggcagagggaaactccttt

SEQ ID NO: 10062855 - DNA, 22 bp, Homo sapiens
cagggccttcgtaagtgtccgg

SEQ ID NO: 10062856 - DNA, 22 bp, Homo sapiens
cagggccttatcctgccattga

SEQ ID NO: 10062857 - DNA, 22 bp, Homo sapiens
cagggcctgtcacgacgctcat

SEQ ID NO: 10062858 - DNA, 22 bp, Homo sapiens
cagggcctcattgtcagtcctg

SEQ ID NO: 10062859 - DNA, 22 bp, Homo sapiens
cagggcctggagctgggcctgc

SEQ ID NO: 10062860 - DNA, 22 bp, Homo sapiens
cagggcacttaaattgcctcgt

SEQ ID NO: 10062861 - DNA, 22 bp, Homo sapiens
cagggcacagatcggggcgcac

SEQ ID NO: 10062862 - DNA, 22 bp, Homo sapiens
cagggcacggagaagtcacccc

SEQ ID NO: 10062863 - DNA, 22 bp, Homo sapiens
cagggcacagttatggaggtgg

SEQ ID NO: 10062864 - DNA, 22 bp, Homo sapiens
cctgaggctcgcgcgcccctgg

SEQ ID NO: 10062865 - DNA, 22 bp, Homo sapiens
cctgaggcttaatctgtcccaa

SEQ ID NO: 10062866 - DNA, 22 bp, Homo sapiens
cctgaggctccacctccagaga

SEQ ID NO: 10062867 - DNA, 22 bp, Homo sapiens
cctgaggcttgggagttccgcc

SEQ ID NO: 10062868 - DNA, 19 bp, Homo sapiens
cctgaccacacaggccttg

SEQ ID NO: 10062869 - DNA, 21 bp, Homo sapiens
cctgaccaatacttgatcaaa

SEQ ID NO: 10062870 - DNA, 22 bp, Homo sapiens
cctgaccaacgtggtgaaaccc

SEQ ID NO: 10062871 - DNA, 22 bp, Homo sapiens
cctgaccatttgccacatgggt

SEQ ID NO: 10062872 - DNA, 22 bp, Homo sapiens
cctgaccagagtgagggcttag

SEQ ID NO: 10062873 - DNA, 21 bp, Homo sapiens
cctgaccattcagcttgtctt

SEQ ID NO: 10062874 - DNA, 22 bp, Homo sapiens
cctgaccagcaggacgggggca

SEQ ID NO: 10062875 - DNA, 19 bp, Homo sapiens
cctgaccagactttgcttc

SEQ ID NO: 10062876 - DNA, 22 bp, Homo sapiens
cctgaccacccttggacaaggt

SEQ ID NO: 10062877 - DNA, 22 bp, Homo sapiens
cctgactctggccaggccagct

SEQ ID NO: 10062878 - DNA, 22 bp, Homo sapiens
cctgccaggagctggtgctgca

SEQ ID NO: 10062879 - DNA, 22 bp, Homo sapiens
cctgcaccacactcactgctca

SEQ ID NO: 10062880 - DNA, 22 bp, Homo sapiens
tgggccagcaattgctgctcag

SEQ ID NO: 10062881 - DNA, 22 bp, Homo sapiens
cctcttctgcttcaggagcact

SEQ ID NO: 10062882 - DNA, 22 bp, Homo sapiens
tgggagcccaagggagctgccg

SEQ ID NO: 10062883 - DNA, 22 bp, Homo sapiens
cctgccaggctttgggcttctg

SEQ ID NO: 10062884 - DNA, 22 bp, Homo sapiens
cctgccaggcgagtctaggcca

SEQ ID NO: 10062885 - DNA, 22 bp, Homo sapiens
cctgcctgtccctcagtccaca

SEQ ID NO: 10062886 - DNA, 22 bp, Homo sapiens
cctgcctgtactagagacccag

SEQ ID NO: 10062887 - DNA, 22 bp, Homo sapiens
cctgcctgtcatcgcctgcgcc

SEQ ID NO: 10062888 - DNA, 20 bp, Homo sapiens
cctgcctgcctcggctcatt

SEQ ID NO: 10062889 - DNA, 22 bp, Homo sapiens
tgtacagttttaactctgaggg

SEQ ID NO: 10062890 - DNA, 22 bp, Homo sapiens
cctggagggcgccgcacagtcc

SEQ ID NO: 10062891 - DNA, 22 bp, Homo sapiens
ccctgccttgttggagcctatg

SEQ ID NO: 10062892 - DNA, 22 bp, Homo sapiens
ccctgccttggggtccacaccg

SEQ ID NO: 10062893 - DNA, 22 bp, Homo sapiens
ccctgcctctgaagctgctcag

SEQ ID NO: 10062894 - DNA, 22 bp, Homo sapiens
tgcctccaccattgctcacttt

SEQ ID NO: 10062895 - DNA, 22 bp, Homo sapiens
tgcctccaacagcccatcctag

SEQ ID NO: 10062896 - DNA, 17 bp, Homo sapiens
tgcctccagcagggtga

SEQ ID NO: 10062897 - DNA, 22 bp, Homo sapiens
tgcctccatgtttcagcatcta

SEQ ID NO: 10062898 - DNA, 22 bp, Homo sapiens
tgcctccaggaggggcagctct

SEQ ID NO: 10062899 - DNA, 22 bp, Homo sapiens
tgcctgcctgcatagtcccacg

SEQ ID NO: 10062900 - DNA, 22 bp, Homo sapiens
tgcctgcctctggagcccatcc

SEQ ID NO: 10062901 - DNA, 22 bp, Homo sapiens
tgcctgcctcaggccgagtgct

SEQ ID NO: 10062902 - DNA, 22 bp, Homo sapiens
tgcctgcctctggcagccctgc

SEQ ID NO: 10062903 - DNA, 22 bp, Homo sapiens
tgcctgccctttccacacagcc

SEQ ID NO: 10062904 - DNA, 22 bp, Homo sapiens
cctcacagccctcctctagcac

SEQ ID NO: 10062905 - DNA, 22 bp, Homo sapiens
ccctgtggaggcagcatcctgc

SEQ ID NO: 10062906 - DNA, 22 bp, Homo sapiens
ccctgggatggattggcaggaa

SEQ ID NO: 10062907 - DNA, 22 bp, Homo sapiens
ccctgggataccagacaccaga

SEQ ID NO: 10062908 - DNA, 22 bp, Homo sapiens
cctcagcatcctggtgaagtag

SEQ ID NO: 10062909 - DNA, 22 bp, Homo sapiens
tggcctcccctaacagcctctt

SEQ ID NO: 10062910 - DNA, 21 bp, Homo sapiens
tggcctcccacacttccatgg

SEQ ID NO: 10062911 - DNA, 22 bp, Homo sapiens
ccatggccgccgctgctcagga

SEQ ID NO: 10062912 - DNA, 22 bp, Homo sapiens
cccaagcagggtgcagaggcat

SEQ ID NO: 10062913 - DNA, 22 bp, Homo sapiens
ccagtgtgggctggtggaggac

SEQ ID NO: 10062914 - DNA, 22 bp, Homo sapiens
ccagtgtgttccctgcctcact

SEQ ID NO: 10062915 - DNA, 22 bp, Homo sapiens
tgaggcagtgctgggaagcctg

SEQ ID NO: 10062916 - DNA, 22 bp, Homo sapiens
cccaggactcggcactctcctt

SEQ ID NO: 10062917 - DNA, 22 bp, Homo sapiens
cccaggactaatgagctctacg

SEQ ID NO: 10062918 - DNA, 22 bp, Homo sapiens
cccaggaggcagaagttgcagt

SEQ ID NO: 10062919 - DNA, 22 bp, Homo sapiens
tgccctcagtttcacatgagtg

SEQ ID NO: 10062920 - DNA, 22 bp, Homo sapiens
ccagcccttgctgaagggtggc

SEQ ID NO: 10062921 - DNA, 21 bp, Homo sapiens
ccagcctcagatcagggagct

SEQ ID NO: 10062922 - DNA, 23 bp, Homo sapiens
ccaggctaaatgttagagtctga

SEQ ID NO: 10062923 - DNA, 22 bp, Homo sapiens
ccaggctcagcgcgcacgtctg

SEQ ID NO: 10062924 - DNA, 22 bp, Homo sapiens
ccagggcatgtaactaatggtg

SEQ ID NO: 10062925 - DNA, 22 bp, Homo sapiens
ccagggcatgtccaagacttag

SEQ ID NO: 10062926 - DNA, 22 bp, Homo sapiens
ccagggccaagagacctcgagg

SEQ ID NO: 10062927 - DNA, 22 bp, Homo sapiens
ccagggcatgggaagaactgaa

SEQ ID NO: 10062928 - DNA, 22 bp, Homo sapiens
ccagggccagtaagattggcat

SEQ ID NO: 10062929 - DNA, 23 bp, Homo sapiens
ccagggcccctacaccactgtcc

SEQ ID NO: 10062930 - DNA, 22 bp, Homo sapiens
tgaccacacttgatcactctga

SEQ ID NO: 10062931 - DNA, 22 bp, Homo sapiens
ccagggttgcagggagccagca

SEQ ID NO: 10062932 - DNA, 23 bp, Homo sapiens
tgagcacctaatgctgggcactg

SEQ ID NO: 10062933 - DNA, 22 bp, Homo sapiens
gagggcctctgtgggtgctcac

SEQ ID NO: 10062934 - DNA, 22 bp, Homo sapiens
gaggccttcctctcaagcacat

SEQ ID NO: 10062935 - DNA, 22 bp, Homo sapiens
gaggcctgtagtcatggatgta

SEQ ID NO: 10062936 - DNA, 22 bp, Homo sapiens
gaggcctggtttgcatgagaat

SEQ ID NO: 10062937 - DNA, 22 bp, Homo sapiens
gaggtgcttcctttgggctctg

SEQ ID NO: 10062938 - DNA, 22 bp, Homo sapiens
gagctgggatttgaacctggga

SEQ ID NO: 10062939 - DNA, 22 bp, Homo sapiens
gagctgggtctccaccttggca

SEQ ID NO: 10062940 - DNA, 22 bp, Homo sapiens
gagagacagcacacagtgtggg

SEQ ID NO: 10062941 - DNA, 22 bp, Homo sapiens
gagcacagatcctggagccaca

SEQ ID NO: 10062942 - DNA, 22 bp, Homo sapiens
ctggggggctactgacagagga

SEQ ID NO: 10062943 - DNA, 22 bp, Homo sapiens
ctgggatggctttcctgcatta

SEQ ID NO: 10062944 - DNA, 22 bp, Homo sapiens
ctgggatgtctatagaacactt

SEQ ID NO: 10062945 - DNA, 22 bp, Homo sapiens
ctgtgaggccctgggtgctgga

SEQ ID NO: 10062946 - DNA, 22 bp, Homo sapiens
cttccagggtccaggaagagcc

SEQ ID NO: 10062947 - DNA, 22 bp, Homo sapiens
cttccaggtccttcttgagaag

SEQ ID NO: 10062948 - DNA, 22 bp, Homo sapiens
cttccaggtaggcctaaggcag

SEQ ID NO: 10062949 - DNA, 22 bp, Homo sapiens
ctttcctctggcactgtctggt

SEQ ID NO: 10062950 - DNA, 22 bp, Homo sapiens
ctccttcacgcaggctgccatg

SEQ ID NO: 10062951 - DNA, 22 bp, Homo sapiens
ctccaggcccctggccttctgc

SEQ ID NO: 10062952 - DNA, 22 bp, Homo sapiens
tttgttcattagtacagttgta

SEQ ID NO: 10062953 - DNA, 21 bp, Homo sapiens
tttgttcaggcaagttacagt

SEQ ID NO: 10062954 - DNA, 22 bp, Homo sapiens
ctctgcagaggcccaaggctga

SEQ ID NO: 10062955 - DNA, 22 bp, Homo sapiens
ctctgcagaatttgagctgctc

SEQ ID NO: 10062956 - DNA, 22 bp, Homo sapiens
ctctgcagagcctccagcccag

SEQ ID NO: 10062957 - DNA, 22 bp, Homo sapiens
ctctggcctgcttcctcaggta

SEQ ID NO: 10062958 - DNA, 22 bp, Homo sapiens
ctgcctggggaatgtgaggatt

SEQ ID NO: 10062959 - DNA, 22 bp, Homo sapiens
ctgccttccaaccccagactcc

SEQ ID NO: 10062960 - DNA, 22 bp, Homo sapiens
ctggaagggagcactgtagaga

SEQ ID NO: 10062961 - DNA, 22 bp, Homo sapiens
ctggagagttggaagatggact

SEQ ID NO: 10062962 - DNA, 22 bp, Homo sapiens
ctgaggcctggccccaccacag

SEQ ID NO: 10062963 - DNA, 22 bp, Homo sapiens
ctgaggtctagacaccccaggg

SEQ ID NO: 10062964 - DNA, 20 bp, Homo sapiens
ctcttccggaggggcgctcc

SEQ ID NO: 10062965 - DNA, 22 bp, Homo sapiens
ctgcccatctgcagacatgcgt

SEQ ID NO: 10062966 - DNA, 22 bp, Homo sapiens
ctgcccattcaaccagctacag

SEQ ID NO: 10062967 - DNA, 22 bp, Homo sapiens
ctgcccccaggctgcatggctg

SEQ ID NO: 10062968 - DNA, 22 bp, Homo sapiens
cgggctggctgcagctgctgga

SEQ ID NO: 10062969 - DNA, 22 bp, Homo sapiens
cgagagccggaaggggcggtgc

SEQ ID NO: 10062970 - DNA, 22 bp, Homo sapiens
ttctgcaggatgctctggtggt

SEQ ID NO: 10062971 - DNA, 17 bp, Homo sapiens
ctcagagcaggacagaa

SEQ ID NO: 10062972 - DNA, 22 bp, Homo sapiens
ctcagagcacttttgaaagctc

SEQ ID NO: 10062973 - DNA, 22 bp, Homo sapiens
ctcagagcacagtttatgacag

SEQ ID NO: 10062974 - DNA, 22 bp, Homo sapiens
ctcagagccccaggagggtgtg

SEQ ID NO: 10062975 - DNA, 21 bp, Homo sapiens
ctcagggcttggtgtcctcat

SEQ ID NO: 10062976 - DNA, 18 bp, Homo sapiens
ctcagggcatcagtctgg

SEQ ID NO: 10062977 - DNA, 22 bp, Homo sapiens
ctcagggctggaaagccaggaa

SEQ ID NO: 10062978 - DNA, 22 bp, Homo sapiens
ctcagggcagtatggctgagag

SEQ ID NO: 10062979 - DNA, 23 bp, Homo sapiens
ctcagaggcctgtccagggtggt

SEQ ID NO: 10062980 - DNA, 22 bp, Homo sapiens
ctccagagtcatcgagcattcc

SEQ ID NO: 10062981 - DNA, 22 bp, Homo sapiens
ctccagagtcacactgcctggg

SEQ ID NO: 10062982 - DNA, 22 bp, Homo sapiens
ctccagaggaaagcacatagtg

SEQ ID NO: 10062983 - DNA, 18 bp, Homo sapiens
ctccagagctgtgagaca

SEQ ID NO: 10062984 - DNA, 22 bp, Homo sapiens
ctccagaggatgcaggtgaggg

SEQ ID NO: 10062985 - DNA, 22 bp, Homo sapiens
ctccagaggtccccgcggcact

SEQ ID NO: 10062986 - DNA, 22 bp, Homo sapiens
ctccagaggttctcatctggga

SEQ ID NO: 10062987 - DNA, 22 bp, Homo sapiens
ctccagaggcgacttgcatcac

SEQ ID NO: 10062988 - DNA, 22 bp, Homo sapiens
ctccagagggtcagactctgag

SEQ ID NO: 10062989 - DNA, 22 bp, Homo sapiens
ggacaggcccggggagcctgga

SEQ ID NO: 10062990 - DNA, 22 bp, Homo sapiens
ggagctggctacagagaactcc

SEQ ID NO: 10062991 - DNA, 22 bp, Homo sapiens
ggagaagaggagctggaagcct

SEQ ID NO: 10062992 - DNA, 22 bp, Homo sapiens
gctggccaggaagagtctcaga

SEQ ID NO: 10062993 - DNA, 22 bp, Homo sapiens
gctggccacactgctgatggag

SEQ ID NO: 10062994 - DNA, 22 bp, Homo sapiens
gctgtcctgggaacaggcacta

SEQ ID NO: 10062995 - DNA, 23 bp, Homo sapiens
gctgtcctcctgggcccagcagc

SEQ ID NO: 10062996 - DNA, 22 bp, Homo sapiens
gctggccaaagtgtacctggag

SEQ ID NO: 10062997 - DNA, 22 bp, Homo sapiens
gctgcctgaaatgttgcctagc

SEQ ID NO: 10062998 - DNA, 22 bp, Homo sapiens
gctgcctgaagtgtctacactg

SEQ ID NO: 10062999 - DNA, 22 bp, Homo sapiens
gctctcttggtggctgtcctgg

SEQ ID NO: 10063000 - DNA, 22 bp, Homo sapiens
gctctcttgacagcttgctgtt

SEQ ID NO: 10063001 - DNA, 22 bp, Homo sapiens
gctctccaggtctcatgcactg

SEQ ID NO: 10063002 - DNA, 22 bp, Homo sapiens
gctctccaggggctcccaggat

SEQ ID NO: 10063003 - DNA, 22 bp, Homo sapiens
gcacagagacagtcctgagatc

SEQ ID NO: 10063004 - DNA, 22 bp, Homo sapiens
gcaggtgaaagtgagtagtgag

SEQ ID NO: 10063005 - DNA, 19 bp, Homo sapiens
gcaggtgagccgtggctcc

SEQ ID NO: 10063006 - DNA, 22 bp, Homo sapiens
gcagggccagtgcagagaggaa

SEQ ID NO: 10063007 - DNA, 22 bp, Homo sapiens
gcagggccaggtacaagaagca

SEQ ID NO: 10063008 - DNA, 22 bp, Homo sapiens
gcagggccagggctcaggctgt

SEQ ID NO: 10063009 - DNA, 22 bp, Homo sapiens
gcagggcatgggccctgtctgc

SEQ ID NO: 10063010 - DNA, 22 bp, Homo sapiens
gcagggcagctgaagctaggtg

SEQ ID NO: 10063011 - DNA, 22 bp, Homo sapiens
gcagggcagcttagtccctgtc

SEQ ID NO: 10063012 - DNA, 22 bp, Homo sapiens
gcagcccaagcctgagcatcct

SEQ ID NO: 10063013 - DNA, 22 bp, Homo sapiens
gccagaccagctgtgattccag

SEQ ID NO: 10063014 - DNA, 22 bp, Homo sapiens
gccaggctctcagtgactgccc

SEQ ID NO: 10063015 - DNA, 22 bp, Homo sapiens
gccaggctaagaaaggtgtgat

SEQ ID NO: 10063016 - DNA, 22 bp, Homo sapiens
gccaggctccaggccctcctga

SEQ ID NO: 10063017 - DNA, 22 bp, Homo sapiens
gcctccctgtttcctgctccaa

SEQ ID NO: 10063018 - DNA, 22 bp, Homo sapiens
gcctccctccaccactgcaggt

SEQ ID NO: 10063019 - DNA, 22 bp, Homo sapiens
gccctcagaggacagctgactt

SEQ ID NO: 10063020 - DNA, 22 bp, Homo sapiens
gcctcaggtgcatctctcattc

SEQ ID NO: 10063021 - DNA, 22 bp, Homo sapiens
gcctcagggggagaggccagct

SEQ ID NO: 10063022 - DNA, 22 bp, Homo sapiens
gggctcagaggagtggcctggg

SEQ ID NO: 10063023 - DNA, 22 bp, Homo sapiens
gggctcagacatccctcctgga

SEQ ID NO: 10063024 - DNA, 22 bp, Homo sapiens
ggctgcatgccaggctttgagc

SEQ ID NO: 10063025 - DNA, 19 bp, Homo sapiens
ggctggagtggccatctgt

SEQ ID NO: 10063026 - DNA, 22 bp, Homo sapiens
gggagccagcagggcatggagc

SEQ ID NO: 10063027 - DNA, 22 bp, Homo sapiens
ggctgtggggggagcctgcccg

SEQ ID NO: 10063028 - DNA, 22 bp, Homo sapiens
ggctgtgctttgcccaaagggc

SEQ ID NO: 10063029 - DNA, 22 bp, Homo sapiens
ggcctccaggcctactcagggc

SEQ ID NO: 10063030 - DNA, 21 bp, Homo sapiens
ggcctcccggaccgcagcgcc

SEQ ID NO: 10063031 - DNA, 22 bp, Homo sapiens
ggcctctctggcatggctgccc

SEQ ID NO: 10063032 - DNA, 21 bp, Homo sapiens
ggcagcctgacccccagagag

SEQ ID NO: 10063033 - DNA, 18 bp, Homo sapiens
ggcagcctggacatgctc

SEQ ID NO: 10063034 - DNA, 22 bp, Homo sapiens
ggcagggcttgtctctgtgatg

SEQ ID NO: 10063035 - DNA, 22 bp, Homo sapiens
ggcagggccctgattcctgggg

SEQ ID NO: 10063036 - DNA, 20 bp, Homo sapiens
ggcagggcatcaacagctct

SEQ ID NO: 10063037 - DNA, 18 bp, Homo sapiens
gggctgtgttcatgccca

SEQ ID NO: 10063038 - DNA, 16 bp, Homo sapiens
gggctgggggattctg

SEQ ID NO: 10063039 - DNA, 22 bp, Homo sapiens
ggggcattgtgtctgggttcct

SEQ ID NO: 10063040 - DNA, 22 bp, Homo sapiens
ggggccagcttcgcgtgctctt

SEQ ID NO: 10063041 - DNA, 22 bp, Homo sapiens
ggggccagcactgtgcctttgt

SEQ ID NO: 10063042 - DNA, 22 bp, Homo sapiens
gggtgcagcagagctcctctgt

SEQ ID NO: 10063043 - DNA, 22 bp, Homo sapiens
gtcctggcccactggcaggctg

SEQ ID NO: 10063044 - DNA, 23 bp, Homo sapiens
gtcctctggagagaaaggcagta

SEQ ID NO: 10063045 - DNA, 22 bp, Homo sapiens
gtccaggctgacccctagagga

SEQ ID NO: 10063046 - DNA, 21 bp, Homo sapiens
gtccagagagccggctcctga

SEQ ID NO: 10063047 - DNA, 18 bp, Homo sapiens
gtgccaggaggcgcagcc

SEQ ID NO: 10063048 - DNA, 22 bp, Homo sapiens
gtgccaggcctattgttaaact

SEQ ID NO: 10063049 - DNA, 22 bp, Homo sapiens
gtgccagggagtggaggagctt

SEQ ID NO: 10063050 - DNA, 22 bp, Homo sapiens
gtgccaggcccagggagcgggg

SEQ ID NO: 10063051 - DNA, 20 bp, Homo sapiens
gtgccaggcaagacaggtgg

SEQ ID NO: 10063052 - DNA, 22 bp, Homo sapiens
gtgccagggggcactgaacaga

SEQ ID NO: 10063053 - DNA, 22 bp, Homo sapiens
gtgccaggtgctaagctgtgct

SEQ ID NO: 10063054 - DNA, 22 bp, Homo sapiens
tagggcagccacccaggctgct

SEQ ID NO: 10063055 - DNA, 22 bp, Homo sapiens
tactgtgtgcccagccgagctg

SEQ ID NO: 10063056 - DNA, 16 bp, Homo sapiens
tcccaggccaggtgga

SEQ ID NO: 10063057 - DNA, 22 bp, Homo sapiens
tccagggcttgacagggtgcct

SEQ ID NO: 10063058 - DNA, 22 bp, Homo sapiens
tccagggctgggttggctcagc

SEQ ID NO: 10063059 - DNA, 22 bp, Homo sapiens
tccaggctggacatgaggcggg

SEQ ID NO: 10063060 - DNA, 22 bp, Homo sapiens
tccaggccttgacaggtcagtt

SEQ ID NO: 10063061 - DNA, 22 bp, Homo sapiens
tcctcaggtcaaagcaggagaa

SEQ ID NO: 10063062 - DNA, 22 bp, Homo sapiens
tcctcaggggtttcaggtgtac

SEQ ID NO: 10063063 - DNA, 19 bp, Homo sapiens
tcctcaggggctcacagac

SEQ ID NO: 10063064 - DNA, 23 bp, Homo sapiens
tcctcagcatgttttgtcatgta

SEQ ID NO: 10063065 - DNA, 20 bp, Homo sapiens
tcccaggctccaccctagac

SEQ ID NO: 10063066 - DNA, 22 bp, Homo sapiens
tcccaggctaccagtgaggtca

SEQ ID NO: 10063067 - DNA, 20 bp, Homo sapiens
tcccaggctgggctccagct

SEQ ID NO: 10063068 - DNA, 22 bp, Homo sapiens
tcccaggctggggccaggtgac

SEQ ID NO: 10063069 - DNA, 22 bp, Homo sapiens
tcctgcaggcttgagtcctcag

SEQ ID NO: 10063070 - DNA, 22 bp, Homo sapiens
tcagggcaggacagtgtaggcc

SEQ ID NO: 10063071 - DNA, 22 bp, Homo sapiens
tcagggcaggcgagcagctgct

SEQ ID NO: 10063072 - DNA, 22 bp, Homo sapiens
tcagggcaggttaacttgggtg

SEQ ID NO: 10063073 - DNA, 21 bp, Homo sapiens
tcagggcagtgggaggttcct

SEQ ID NO: 10063074 - DNA, 19 bp, Homo sapiens
tcagggcagtccggtcccc

SEQ ID NO: 10063075 - DNA, 22 bp, Homo sapiens
tcagggcctttgcagttgtttt

SEQ ID NO: 10063076 - DNA, 22 bp, Homo sapiens
tcagggctgcatacaggagata

SEQ ID NO: 10063077 - DNA, 22 bp, Homo sapiens
tcagggctgcagaagaggcagg

SEQ ID NO: 10063078 - DNA, 22 bp, Homo sapiens
tcagggccggggctgtggcgag

SEQ ID NO: 10063079 - DNA, 19 bp, Homo sapiens
tcagggccgcagagggtac

SEQ ID NO: 10063080 - DNA, 22 bp, Homo sapiens
tcagggccgccggggatctcgc

SEQ ID NO: 10063081 - DNA, 22 bp, Homo sapiens
tcagggcatctcttaagtggtg

SEQ ID NO: 10063082 - DNA, 22 bp, Homo sapiens
tcagggccctggacaaccctcc

SEQ ID NO: 10063083 - DNA, 22 bp, Homo sapiens
tcagccagagggggcaaaggaa

SEQ ID NO: 10063084 - DNA, 22 bp, Homo sapiens
tcagccagctgtgtgcttctgc

SEQ ID NO: 10063085 - DNA, 22 bp, Homo sapiens
tcagctggagatgagaaccgaa

SEQ ID NO: 10063086 - DNA, 19 bp, Homo sapiens
tcacagtgcagaaccctcc

SEQ ID NO: 10063087 - DNA, 22 bp, Homo sapiens
ttgtcagggactggaaaagaaa

SEQ ID NO: 10063088 - DNA, 22 bp, Homo sapiens
ttgtcaggcctatgagagatct

SEQ ID NO: 10063089 - DNA, 22 bp, Homo sapiens
ttgtcaggtgggagaacagtca

SEQ ID NO: 10063090 - DNA, 22 bp, Homo sapiens
ttcagagcttagaatggactac

SEQ ID NO: 10063091 - DNA, 22 bp, Homo sapiens
ttcagagcccaaatggagatta

SEQ ID NO: 10063092 - DNA, 22 bp, Homo sapiens
ttccagggaagagcaaggcagt

SEQ ID NO: 10063093 - DNA, 18 bp, Homo sapiens
tcctgcctgtgccccagg

SEQ ID NO: 10063094 - DNA, 19 bp, Homo sapiens
tcctgcctggggccgcctg

SEQ ID NO: 10063095 - DNA, 18 bp, Homo sapiens
tcctgcctgcgggctccc

SEQ ID NO: 10063096 - DNA, 22 bp, Homo sapiens
ttcctggcctctctctgagcag

SEQ ID NO: 10063097 - DNA, 22 bp, Homo sapiens
ttcctggcgccacggagccggt

SEQ ID NO: 10063098 - DNA, 22 bp, Homo sapiens
ttcctggcattatgggaggctg

SEQ ID NO: 10063099 - DNA, 22 bp, Homo sapiens
tttgttcaaaaattataagata

SEQ ID NO: 10063100 - DNA, 21 bp, Homo sapiens
tttgttcacacacagggcagc

SEQ ID NO: 10063101 - DNA, 22 bp, Homo sapiens
tttgttcaatccagacaatagc

SEQ ID NO: 10063102 - DNA, 22 bp, Homo sapiens
agagcctggctcccagctaccg

SEQ ID NO: 10063103 - DNA, 23 bp, Homo sapiens
acaacaggaaatcagacctgaac

SEQ ID NO: 10063104 - DNA, 22 bp, Homo sapiens
acagaactttctgatcctgagc

SEQ ID NO: 10063105 - DNA, 22 bp, Homo sapiens
acctgcctcagtgcagctggat

SEQ ID NO: 10063106 - DNA, 22 bp, Homo sapiens
acctgcctctaagcagcaggtg

SEQ ID NO: 10063107 - DNA, 22 bp, Homo sapiens
acagctggaggggctgcagagg

SEQ ID NO: 10063108 - DNA, 15 bp, Homo sapiens
acctctctcgctggc

SEQ ID NO: 10063109 - DNA, 22 bp, Homo sapiens
acctctctgggcctgcttcctg

SEQ ID NO: 10063110 - DNA, 22 bp, Homo sapiens
acctctcttgtagctgctggtg

SEQ ID NO: 10063111 - DNA, 22 bp, Homo sapiens
acctgcctatcagctgcctgct

SEQ ID NO: 10063112 - DNA, 22 bp, Homo sapiens
aagggctggatctctctgagca

SEQ ID NO: 10063113 - DNA, 22 bp, Homo sapiens
aagggcacagggaaagagtgca

SEQ ID NO: 10063114 - DNA, 22 bp, Homo sapiens
acacagaagctttttctattcc

SEQ ID NO: 10063115 - DNA, 22 bp, Homo sapiens
agtgggaggaagtggtgatatt

SEQ ID NO: 10063116 - DNA, 22 bp, Homo sapiens
agtgggagccagcagcttgggg

SEQ ID NO: 10063117 - DNA, 22 bp, Homo sapiens
aggttccttatggggatggcta

SEQ ID NO: 10063118 - DNA, 22 bp, Homo sapiens
agggcacaagactctgagcccc

SEQ ID NO: 10063119 - DNA, 22 bp, Homo sapiens
agggccagcagcttggccaacc

SEQ ID NO: 10063120 - DNA, 22 bp, Homo sapiens
agggccagcactcctggcagga

SEQ ID NO: 10063121 - DNA, 22 bp, Homo sapiens
aggctgtgatgagcctcatgga

SEQ ID NO: 10063122 - DNA, 22 bp, Homo sapiens
aggctgggaaacctgaagttgt

SEQ ID NO: 10063123 - DNA, 22 bp, Homo sapiens
aggctgggaaatgtattccagc

SEQ ID NO: 10063124 - DNA, 22 bp, Homo sapiens
aggctgggaaatgtagtcttcc

SEQ ID NO: 10063125 - DNA, 22 bp, Homo sapiens
acaggaagaaagtgcagtagat

SEQ ID NO: 10063126 - DNA, 22 bp, Homo sapiens
acagggcctcagccagggcaga

SEQ ID NO: 10063127 - DNA, 22 bp, Homo sapiens
acagggcctggctccaaaagat

SEQ ID NO: 10063128 - DNA, 22 bp, Homo sapiens
acagggcccttagatcctttta

SEQ ID NO: 10063129 - DNA, 22 bp, Homo sapiens
acagggccctgtgggccccact

SEQ ID NO: 10063130 - DNA, 22 bp, Homo sapiens
acagggccattatctgttctag

SEQ ID NO: 10063131 - DNA, 22 bp, Homo sapiens
acagggccaggtgagaggtgct

SEQ ID NO: 10063132 - DNA, 22 bp, Homo sapiens
acagggccacatgtaaacagat

SEQ ID NO: 10063133 - DNA, 22 bp, Homo sapiens
acagggccttatatccagaagg

SEQ ID NO: 10063134 - DNA, 22 bp, Homo sapiens
acaggccttggtcctgacctaa

SEQ ID NO: 10063135 - DNA, 22 bp, Homo sapiens
acaggcctggtgctgctgacag

SEQ ID NO: 10063136 - DNA, 22 bp, Homo sapiens
acagggcaggtggctactggtc

SEQ ID NO: 10063137 - DNA, 22 bp, Homo sapiens
acagggccaagtaaaccctacc

SEQ ID NO: 10063138 - DNA, 21 bp, Homo sapiens
acagggcatgcagctggctgt

SEQ ID NO: 10063139 - DNA, 22 bp, Homo sapiens
aggcagtgtgtagctggaagag

SEQ ID NO: 10063140 - DNA, 22 bp, Homo sapiens
aggcaggggagctggaagggta

SEQ ID NO: 10063141 - DNA, 22 bp, Homo sapiens
agaggccggccgagcccatggg

SEQ ID NO: 10063142 - DNA, 19 bp, Homo sapiens
agaggcctcagcagctggc

SEQ ID NO: 10063143 - DNA, 22 bp, Homo sapiens
agaggccagggacactgctcaa

SEQ ID NO: 10063144 - DNA, 22 bp, Homo sapiens
agaggccctggctagagcagct

SEQ ID NO: 10063145 - DNA, 22 bp, Homo sapiens
agatttatgtggtcacactcag

SEQ ID NO: 10063146 - DNA, 22 bp, Homo sapiens
agagccagcatttgggccctgc

SEQ ID NO: 10063147 - DNA, 22 bp, Homo sapiens
agagcctgttttgtgggagatg

SEQ ID NO: 10063148 - DNA, 22 bp, Homo sapiens
agagaacatgacgtaatagtgg

SEQ ID NO: 10063149 - DNA, 22 bp, Homo sapiens
atgccagggtcatcccctgggt

SEQ ID NO: 10063150 - DNA, 22 bp, Homo sapiens
atgccaggctgtttggcctcag

SEQ ID NO: 10063151 - DNA, 23 bp, Homo sapiens
atgccaggctgcctggccagcct

SEQ ID NO: 10063152 - DNA, 22 bp, Homo sapiens
agagaacagcattgcagctttg

SEQ ID NO: 10063153 - DNA, 22 bp, Homo sapiens
agagaacacgtgcatctgcaat

SEQ ID NO: 10063154 - DNA, 22 bp, Homo sapiens
caaggaaacatgaaatgcattg

SEQ ID NO: 10063155 - DNA, 22 bp, Homo sapiens
cacagctgcacagaggaggtgc

SEQ ID NO: 10063156 - DNA, 22 bp, Homo sapiens
cacacttgcttcagagtcaagt

SEQ ID NO: 10063157 - DNA, 22 bp, Homo sapiens
cagcctctgacaccacagtcgt

SEQ ID NO: 10063158 - DNA, 22 bp, Homo sapiens
cagctgggtggctcttctgctc

SEQ ID NO: 10063159 - DNA, 22 bp, Homo sapiens
agcgcaggaacacgtctgcctt

SEQ ID NO: 10063160 - DNA, 22 bp, Homo sapiens
cagcactgggaccactagaaca

SEQ ID NO: 10063161 - DNA, 22 bp, Homo sapiens
cagcactggggccactggagtt

SEQ ID NO: 10063162 - DNA, 22 bp, Homo sapiens
cagcactgttcccagaccactg

SEQ ID NO: 10063163 - DNA, 22 bp, Homo sapiens
cagcctcctgggacactcaccg

SEQ ID NO: 10063164 - DNA, 22 bp, Homo sapiens
cagcctctaagcacagcctctc

SEQ ID NO: 10063165 - DNA, 22 bp, Homo sapiens
cagcccaggtctctcttccagt

SEQ ID NO: 10063166 - DNA, 22 bp, Homo sapiens
agccaggccttttctcaaggtt

SEQ ID NO: 10063167 - DNA, 22 bp, Homo sapiens
agccaggctcaaggcctgctcc

SEQ ID NO: 10063168 - DNA, 22 bp, Homo sapiens
agccaggctgcagttggctggc

SEQ ID NO: 10063169 - DNA, 16 bp, Homo sapiens
agccaggctgcctcgg

SEQ ID NO: 10063170 - DNA, 22 bp, Homo sapiens
agccagggaggtggaggttgca

SEQ ID NO: 10063171 - DNA, 22 bp, Homo sapiens
cagagccatcccagcctgtggt

SEQ ID NO: 10063172 - DNA, 22 bp, Homo sapiens
cagagccataaaggtgaaagag

SEQ ID NO: 10063173 - DNA, 22 bp, Homo sapiens
cagagccatccaggtgcctgtt

SEQ ID NO: 10063174 - DNA, 22 bp, Homo sapiens
cagagccagggctaggaactgg

SEQ ID NO: 10063175 - DNA, 22 bp, Homo sapiens
cagagccaggcctgccctcttt

SEQ ID NO: 10063176 - DNA, 22 bp, Homo sapiens
cagagccaggtctaggagtctc

SEQ ID NO: 10063177 - DNA, 17 bp, Homo sapiens
cagaggagctttggggg

SEQ ID NO: 10063178 - DNA, 22 bp, Homo sapiens
cagagtgagggcctgcacctgc

SEQ ID NO: 10063179 - DNA, 22 bp, Homo sapiens
agccctcttcccagatgcctca

SEQ ID NO: 10063180 - DNA, 22 bp, Homo sapiens
agcctgagtgcttaggactgtt

SEQ ID NO: 10063181 - DNA, 22 bp, Homo sapiens
gactacaacaataagaacagct

SEQ ID NO: 10063182 - DNA, 22 bp, Homo sapiens
gaccacacttttcccctgctag

SEQ ID NO: 10063183 - DNA, 22 bp, Homo sapiens
gaccacagagcacggcctgctt

SEQ ID NO: 10063184 - DNA, 22 bp, Homo sapiens
atgtcctggcccgaggatggag

SEQ ID NO: 10063185 - DNA, 22 bp, Homo sapiens
atgtcctcggctctgtgctgct

SEQ ID NO: 10063186 - DNA, 18 bp, Homo sapiens
atggtctcatactgggag

SEQ ID NO: 10063187 - DNA, 22 bp, Homo sapiens
gcagggctgcagagggcactgt

SEQ ID NO: 10063188 - DNA, 22 bp, Homo sapiens
gcagggctgatggcttccctca

SEQ ID NO: 10063189 - DNA, 22 bp, Homo sapiens
gcaggcctggtttacatggtag

SEQ ID NO: 10063190 - DNA, 22 bp, Homo sapiens
gcctgacctcttctgccctggg

SEQ ID NO: 10063191 - DNA, 21 bp, Homo sapiens
gcctgaccttactactggggt

SEQ ID NO: 10063192 - DNA, 22 bp, Homo sapiens
gctgaccattaggaggacgata

SEQ ID NO: 10063193 - DNA, 22 bp, Homo sapiens
gctgaccatgaattaagcatct

SEQ ID NO: 10063194 - DNA, 20 bp, Homo sapiens
gctgaccataaatcacactg

SEQ ID NO: 10063195 - DNA, 22 bp, Homo sapiens
cagcctctttccacatcaggca

SEQ ID NO: 10063196 - DNA, 22 bp, Homo sapiens
cagcctgggctccagagtccct

SEQ ID NO: 10063197 - DNA, 22 bp, Homo sapiens
cagcctggtccccggctcaccc

SEQ ID NO: 10063198 - DNA, 22 bp, Homo sapiens
cagcctggcctgggactgctga

SEQ ID NO: 10063199 - DNA, 22 bp, Homo sapiens
cagcctggagccacagcccagg

SEQ ID NO: 10063200 - DNA, 22 bp, Homo sapiens
cagcctggacagcgaccagagt

SEQ ID NO: 10063201 - DNA, 22 bp, Homo sapiens
cagccaggtatgggcgtgcggg

SEQ ID NO: 10063202 - DNA, 22 bp, Homo sapiens
cagccagggtcaggcagcttct

SEQ ID NO: 10063203 - DNA, 22 bp, Homo sapiens
cagccaggggctggcgtgttga

SEQ ID NO: 10063204 - DNA, 22 bp, Homo sapiens
cagccagggagggcaaatgaga

SEQ ID NO: 10063205 - DNA, 22 bp, Homo sapiens
cagccctcaggtcctcagcagc

SEQ ID NO: 10063206 - DNA, 22 bp, Homo sapiens
cagccaggcctggtgaccaaag

SEQ ID NO: 10063207 - DNA, 22 bp, Homo sapiens
gtcccaggagttgctgggcctt

SEQ ID NO: 10063208 - DNA, 22 bp, Homo sapiens
gtcccaggcaggccactggcag

SEQ ID NO: 10063209 - DNA, 22 bp, Homo sapiens
gtcccaggaacattctggctag

SEQ ID NO: 10063210 - DNA, 20 bp, Homo sapiens
cagcaggctatggggcaccc

SEQ ID NO: 10063211 - DNA, 22 bp, Homo sapiens
cagcagctggtgagacacagcc

SEQ ID NO: 10063212 - DNA, 22 bp, Homo sapiens
cagagcctctcagaggtcagac

SEQ ID NO: 10063213 - DNA, 22 bp, Homo sapiens
cagaggagaattgcgggatcat

SEQ ID NO: 10063214 - DNA, 19 bp, Homo sapiens
cagagcctcagagctagaa

SEQ ID NO: 10063215 - DNA, 22 bp, Homo sapiens
cagagccgggagccagtcacag

SEQ ID NO: 10063216 - DNA, 22 bp, Homo sapiens
gggccagagcttggcagctggg

SEQ ID NO: 10063217 - DNA, 22 bp, Homo sapiens
gggcagcatgtcactagcatgg

SEQ ID NO: 10063218 - DNA, 22 bp, Homo sapiens
cagacctcagtcctcagtagga

SEQ ID NO: 10063219 - DNA, 22 bp, Homo sapiens
cagaccagaaggaagccgacaa

SEQ ID NO: 10063220 - DNA, 22 bp, Homo sapiens
ggtgacagtggttaaaatttgt

SEQ ID NO: 10063221 - DNA, 21 bp, Homo sapiens
cagaggggctagcctggctgc

SEQ ID NO: 10063222 - DNA, 20 bp, Homo sapiens
ggagctggcatccagcctct

SEQ ID NO: 10063223 - DNA, 22 bp, Homo sapiens
cacaggagaaaggggaagctcg

SEQ ID NO: 10063224 - DNA, 22 bp, Homo sapiens
gctgttcacattttgggccaaa

SEQ ID NO: 10063225 - DNA, 22 bp, Homo sapiens
caaggccttcgtctcctagctt

SEQ ID NO: 10063226 - DNA, 22 bp, Homo sapiens
caaggcctatgcacacctagga

SEQ ID NO: 10063227 - DNA, 22 bp, Homo sapiens
ggcctgggctccgggagttact

SEQ ID NO: 10063228 - DNA, 22 bp, Homo sapiens
ggctgaggcggcgatgcccttg

SEQ ID NO: 10063229 - DNA, 22 bp, Homo sapiens
ggctgggaggatgacttgctac

SEQ ID NO: 10063230 - DNA, 22 bp, Homo sapiens
ccacccagccagatgcaggaag

SEQ ID NO: 10063231 - DNA, 22 bp, Homo sapiens
ccacctggggctgtggcccctt

SEQ ID NO: 10063232 - DNA, 22 bp, Homo sapiens
ccacggccacccgctcatgggc

SEQ ID NO: 10063233 - DNA, 22 bp, Homo sapiens
ccacagtgttttgtcacattag

SEQ ID NO: 10063234 - DNA, 23 bp, Homo sapiens
aggagccaggaaccagcttcccc

SEQ ID NO: 10063235 - DNA, 22 bp, Homo sapiens
aggagccaggaaacctgctctg

SEQ ID NO: 10063236 - DNA, 22 bp, Homo sapiens
aggagccagattctctcacttt

SEQ ID NO: 10063237 - DNA, 22 bp, Homo sapiens
aggagccagtggagttcctgcc

SEQ ID NO: 10063238 - DNA, 22 bp, Homo sapiens
aggaagaaacctactagagttt

SEQ ID NO: 10063239 - DNA, 22 bp, Homo sapiens
caggagcccagagtcctcagct

SEQ ID NO: 10063240 - DNA, 22 bp, Homo sapiens
caggagcagagggtggtcagca

SEQ ID NO: 10063241 - DNA, 22 bp, Homo sapiens
caggagcatgctgatgccagaa

SEQ ID NO: 10063242 - DNA, 22 bp, Homo sapiens
caggactggaagtctcaagaga

SEQ ID NO: 10063243 - DNA, 22 bp, Homo sapiens
caggactgatgttcctccagcc

SEQ ID NO: 10063244 - DNA, 22 bp, Homo sapiens
caggagaaatgtggctgctacc

SEQ ID NO: 10063245 - DNA, 22 bp, Homo sapiens
caggactgaagggcacagggaa

SEQ ID NO: 10063246 - DNA, 22 bp, Homo sapiens
caggcagcgtcctgcttcctgt

SEQ ID NO: 10063247 - DNA, 22 bp, Homo sapiens
caggcagcctgcggtctgcaca

SEQ ID NO: 10063248 - DNA, 22 bp, Homo sapiens
aggctgtgggaatggctgcttg

SEQ ID NO: 10063249 - DNA, 22 bp, Homo sapiens
ccagtgtgaccatctgttagct

SEQ ID NO: 10063250 - DNA, 22 bp, Homo sapiens
aggctcagcctgggcctagagc

SEQ ID NO: 10063251 - DNA, 20 bp, Homo sapiens
ccaggcctgggcctgctcta

SEQ ID NO: 10063252 - DNA, 22 bp, Homo sapiens
ccaggcctgtgttgtgtggagg

SEQ ID NO: 10063253 - DNA, 22 bp, Homo sapiens
ccaggccttctgaggacactct

SEQ ID NO: 10063254 - DNA, 22 bp, Homo sapiens
ccaggcctttcttcttggtctg

SEQ ID NO: 10063255 - DNA, 22 bp, Homo sapiens
ccagggcagcagaattggggca

SEQ ID NO: 10063256 - DNA, 22 bp, Homo sapiens
ccaggcacggtggctcatgcct

SEQ ID NO: 10063257 - DNA, 18 bp, Homo sapiens
ccagaggcccgggcaggc

SEQ ID NO: 10063258 - DNA, 22 bp, Homo sapiens
ccagccagggaaactttttctt

SEQ ID NO: 10063259 - DNA, 22 bp, Homo sapiens
ccagccagtatattccaaagcc

SEQ ID NO: 10063260 - DNA, 22 bp, Homo sapiens
ccagccaggctggctgtggagg

SEQ ID NO: 10063261 - DNA, 22 bp, Homo sapiens
ccagccaggcattgcaaactga

SEQ ID NO: 10063262 - DNA, 22 bp, Homo sapiens
ccagccagctggttggacgcct

SEQ ID NO: 10063263 - DNA, 22 bp, Homo sapiens
ccagccagccttgatctgagta

SEQ ID NO: 10063264 - DNA, 22 bp, Homo sapiens
ccagccagctgcccttggggcc

SEQ ID NO: 10063265 - DNA, 22 bp, Homo sapiens
ccagccagcaagctcccagttc

SEQ ID NO: 10063266 - DNA, 22 bp, Homo sapiens
ccagccagaagtccgggcttct

SEQ ID NO: 10063267 - DNA, 22 bp, Homo sapiens
ccagccagatgataagctctat

SEQ ID NO: 10063268 - DNA, 22 bp, Homo sapiens
ccctgaggcacaggccacgtat

SEQ ID NO: 10063269 - DNA, 22 bp, Homo sapiens
cccaggcctggtctgggccagt

SEQ ID NO: 10063270 - DNA, 21 bp, Homo sapiens
agggcctgtgctctccaggtc

SEQ ID NO: 10063271 - DNA, 22 bp, Homo sapiens
agggcctgtgaattctccctgc

SEQ ID NO: 10063272 - DNA, 22 bp, Homo sapiens
cctcagggtcatcctagtaata

SEQ ID NO: 10063273 - DNA, 22 bp, Homo sapiens
cctcagggtctctcacagcacc

SEQ ID NO: 10063274 - DNA, 22 bp, Homo sapiens
cctcagggtctgaggagaccgt

SEQ ID NO: 10063275 - DNA, 23 bp, Homo sapiens
cctcaggggacctgtgagcctga

SEQ ID NO: 10063276 - DNA, 18 bp, Homo sapiens
cctcaggggacctggcag

SEQ ID NO: 10063277 - DNA, 22 bp, Homo sapiens
cctcagggccatctctgtccct

SEQ ID NO: 10063278 - DNA, 22 bp, Homo sapiens
agggctgggctgcttgttgtca

SEQ ID NO: 10063279 - DNA, 22 bp, Homo sapiens
cctcagggaggcctctgtggct

SEQ ID NO: 10063280 - DNA, 22 bp, Homo sapiens
aggggaaggccagcctgtagag

SEQ ID NO: 10063281 - DNA, 22 bp, Homo sapiens
cctgttcaccatggtcacgtgc

SEQ ID NO: 10063282 - DNA, 22 bp, Homo sapiens
cctgttcaagttgcagggctgg

SEQ ID NO: 10063283 - DNA, 22 bp, Homo sapiens
aggtttgttaaaccagattgct

SEQ ID NO: 10063284 - DNA, 22 bp, Homo sapiens
aggtttgttttggaaagatcat

SEQ ID NO: 10063285 - DNA, 22 bp, Homo sapiens
aggtttgtgtcttgcttaaggt

SEQ ID NO: 10063286 - DNA, 23 bp, Homo sapiens
aggtttgtctcagaggcagagtt

SEQ ID NO: 10063287 - DNA, 22 bp, Homo sapiens
cctggctctgcgtgcagctccg

SEQ ID NO: 10063288 - DNA, 22 bp, Homo sapiens
cctggctctggttccctcagct

SEQ ID NO: 10063289 - DNA, 22 bp, Homo sapiens
cctgccagatcccctgagctga

SEQ ID NO: 10063290 - DNA, 22 bp, Homo sapiens
cctgccagctgtgggccagcct

SEQ ID NO: 10063291 - DNA, 21 bp, Homo sapiens
cctgccaggaaactgagtgtc

SEQ ID NO: 10063292 - DNA, 23 bp, Homo sapiens
cctggcacacagttgacatggaa

SEQ ID NO: 10063293 - DNA, 18 bp, Homo sapiens
cctggcacactggctcat

SEQ ID NO: 10063294 - DNA, 22 bp, Homo sapiens
aggtcctctcccagggtactgc

SEQ ID NO: 10063295 - DNA, 22 bp, Homo sapiens
ctccagagatacacggtcttgc

SEQ ID NO: 10063296 - DNA, 22 bp, Homo sapiens
ctccagagatccattgaatgta

SEQ ID NO: 10063297 - DNA, 22 bp, Homo sapiens
ctccagagccagtgcttttcca

SEQ ID NO: 10063298 - DNA, 22 bp, Homo sapiens
agtcctctggagtatgccttat

SEQ ID NO: 10063299 - DNA, 22 bp, Homo sapiens
ctccctccctacgtgagctcac

SEQ ID NO: 10063300 - DNA, 22 bp, Homo sapiens
ctccctccaaataagactcggg

SEQ ID NO: 10063301 - DNA, 22 bp, Homo sapiens
ctcctgggtcattgccagcaaa

SEQ ID NO: 10063302 - DNA, 22 bp, Homo sapiens
ctctgcctgtctcatcctgcaa

SEQ ID NO: 10063303 - DNA, 22 bp, Homo sapiens
ctctgcagtgtaacagcgcttg

SEQ ID NO: 10063304 - DNA, 22 bp, Homo sapiens
ctctgcctgccactgttcaggc

SEQ ID NO: 10063305 - DNA, 22 bp, Homo sapiens
ctctgcaggggaggcatgcact

SEQ ID NO: 10063306 - DNA, 22 bp, Homo sapiens
ctctgcaggcacccagggtggg

SEQ ID NO: 10063307 - DNA, 23 bp, Homo sapiens
ctctgcaggagagtgggcagggc

SEQ ID NO: 10063308 - DNA, 22 bp, Homo sapiens
agtgtctgcctgggaggagcat

SEQ ID NO: 10063309 - DNA, 22 bp, Homo sapiens
agtgtctgcgggcagaggagcg

SEQ ID NO: 10063310 - DNA, 22 bp, Homo sapiens
atctgcaggatgttaggatgat

SEQ ID NO: 10063311 - DNA, 22 bp, Homo sapiens
cttccaggttctggttgggaag

SEQ ID NO: 10063312 - DNA, 22 bp, Homo sapiens
cttcctcccggcccatgctctg

SEQ ID NO: 10063313 - DNA, 20 bp, Homo sapiens
ctgcagggttagaggctcca

SEQ ID NO: 10063314 - DNA, 22 bp, Homo sapiens
ctgcagagatgaagaaggtggc

SEQ ID NO: 10063315 - DNA, 22 bp, Homo sapiens
ctgcagggtttttcaaggacaa

SEQ ID NO: 10063316 - DNA, 22 bp, Homo sapiens
ctggctccatccttgagctctg

SEQ ID NO: 10063317 - DNA, 22 bp, Homo sapiens
ctgctgccattagggcacagac

SEQ ID NO: 10063318 - DNA, 22 bp, Homo sapiens
ctgctgccaagggtgccacagg

SEQ ID NO: 10063319 - DNA, 22 bp, Homo sapiens
tcagagagttttcactagggtg

SEQ ID NO: 10063320 - DNA, 19 bp, Homo sapiens
tccaggagcaaagccagtt

SEQ ID NO: 10063321 - DNA, 22 bp, Homo sapiens
ccagagaccagaacatggggat

SEQ ID NO: 10063322 - DNA, 22 bp, Homo sapiens
ccagagacaaggagctggagtc

SEQ ID NO: 10063323 - DNA, 22 bp, Homo sapiens
ccaaggcccctgtggtctagcc

SEQ ID NO: 10063324 - DNA, 22 bp, Homo sapiens
tcctgggaggaacatttaccta

SEQ ID NO: 10063325 - DNA, 22 bp, Homo sapiens
tcctgggagcatgaagagggat

SEQ ID NO: 10063326 - DNA, 22 bp, Homo sapiens
tcctgggagcacatggtcctgc

SEQ ID NO: 10063327 - DNA, 22 bp, Homo sapiens
tcctgggagagtttgattcatt

SEQ ID NO: 10063328 - DNA, 22 bp, Homo sapiens
tcctgggagcccttgctccacc

SEQ ID NO: 10063329 - DNA, 22 bp, Homo sapiens
tcctgggagcatggtgccgtga

SEQ ID NO: 10063330 - DNA, 22 bp, Homo sapiens
tcctgggactctttatcagaga

SEQ ID NO: 10063331 - DNA, 22 bp, Homo sapiens
tcctgggagagtgggactgtat

SEQ ID NO: 10063332 - DNA, 22 bp, Homo sapiens
tcctgggagacccagctgtgga

SEQ ID NO: 10063333 - DNA, 22 bp, Homo sapiens
tcctgggactttcaaggctagg

SEQ ID NO: 10063334 - DNA, 22 bp, Homo sapiens
ccacactgaacctcagtgtctt

SEQ ID NO: 10063335 - DNA, 20 bp, Homo sapiens
cagggctctgggcctggcct

SEQ ID NO: 10063336 - DNA, 22 bp, Homo sapiens
cagggctcttccggagcaggga

SEQ ID NO: 10063337 - DNA, 22 bp, Homo sapiens
cagggccattggcgtggctgtc

SEQ ID NO: 10063338 - DNA, 22 bp, Homo sapiens
cagggccagggctatggtgaag

SEQ ID NO: 10063339 - DNA, 22 bp, Homo sapiens
cagggccaggctgatggcctgg

SEQ ID NO: 10063340 - DNA, 22 bp, Homo sapiens
cagggccagggctccatttcct

SEQ ID NO: 10063341 - DNA, 22 bp, Homo sapiens
cagggccagttctcgcagcagt

SEQ ID NO: 10063342 - DNA, 16 bp, Homo sapiens
caggtgcctctcccga

SEQ ID NO: 10063343 - DNA, 22 bp, Homo sapiens
caggtgcccagctcctgctgtg

SEQ ID NO: 10063344 - DNA, 22 bp, Homo sapiens
caggtgaatcacttgagtccag

SEQ ID NO: 10063345 - DNA, 19 bp, Homo sapiens
caggcctcttaccctctct

SEQ ID NO: 10063346 - DNA, 22 bp, Homo sapiens
caggcctcttccatgcagcagc

SEQ ID NO: 10063347 - DNA, 22 bp, Homo sapiens
caggcctgcaggaaaggctccc

SEQ ID NO: 10063348 - DNA, 22 bp, Homo sapiens
caggcctcctatgagcactagc

SEQ ID NO: 10063349 - DNA, 22 bp, Homo sapiens
caggcccagggagggagaccaa

SEQ ID NO: 10063350 - DNA, 22 bp, Homo sapiens
caggcctcgaggagacagctac

SEQ ID NO: 10063351 - DNA, 22 bp, Homo sapiens
caggcctctatggtcagctgag

SEQ ID NO: 10063352 - DNA, 19 bp, Homo sapiens
caggcctctggtctgctgt

SEQ ID NO: 10063353 - DNA, 22 bp, Homo sapiens
caggcctctccttagtctggca

SEQ ID NO: 10063354 - DNA, 22 bp, Homo sapiens
caggctcaaggctgacttccat

SEQ ID NO: 10063355 - DNA, 22 bp, Homo sapiens
cagggacagagactgcaccttg

SEQ ID NO: 10063356 - DNA, 22 bp, Homo sapiens
caggctgccctagcttggacat

SEQ ID NO: 10063357 - DNA, 22 bp, Homo sapiens
cagctcagacgcaggtcgagca

SEQ ID NO: 10063358 - DNA, 22 bp, Homo sapiens
ccatgcctcgggaagagtctgt

SEQ ID NO: 10063359 - DNA, 22 bp, Homo sapiens
tgagaccttggggagccctgtt

SEQ ID NO: 10063360 - DNA, 22 bp, Homo sapiens
tgaggcagaaattcctgttttc

SEQ ID NO: 10063361 - DNA, 22 bp, Homo sapiens
ccagggcttcccacgtgccctg

SEQ ID NO: 10063362 - DNA, 22 bp, Homo sapiens
ccaggagaagcatctgagtgta

SEQ ID NO: 10063363 - DNA, 22 bp, Homo sapiens
ccaggagaataatggcagatta

SEQ ID NO: 10063364 - DNA, 22 bp, Homo sapiens
tctggcagctcagttcaggtct

SEQ ID NO: 10063365 - DNA, 22 bp, Homo sapiens
tctggcctgaaagtccatgctt

SEQ ID NO: 10063366 - DNA, 22 bp, Homo sapiens
ccaggacctggagctctatgaa

SEQ ID NO: 10063367 - DNA, 22 bp, Homo sapiens
ccagagacgtcggtcagggcgc

SEQ ID NO: 10063368 - DNA, 19 bp, Homo sapiens
ccaggccatcccagttccc

SEQ ID NO: 10063369 - DNA, 18 bp, Homo sapiens
ccaggccatgaacctctg

SEQ ID NO: 10063370 - DNA, 22 bp, Homo sapiens
ccaggctctgtgtgggctagag

SEQ ID NO: 10063371 - DNA, 22 bp, Homo sapiens
ccaggctgaatatgttccaggg

SEQ ID NO: 10063372 - DNA, 22 bp, Homo sapiens
ccaggcctggacgggtggcctg

SEQ ID NO: 10063373 - DNA, 22 bp, Homo sapiens
tcttcagagcatttctgaggta

SEQ ID NO: 10063374 - DNA, 22 bp, Homo sapiens
ccaggccagcgctggctggagg

SEQ ID NO: 10063375 - DNA, 22 bp, Homo sapiens
ccaggccagcctggagcatggc

SEQ ID NO: 10063376 - DNA, 22 bp, Homo sapiens
ccaggccagcaggcacacctgc

SEQ ID NO: 10063377 - DNA, 22 bp, Homo sapiens
ccaggccagagtgcagtggcac

SEQ ID NO: 10063378 - DNA, 22 bp, Homo sapiens
ccaggagacaaagatgactgct

SEQ ID NO: 10063379 - DNA, 22 bp, Homo sapiens
ccaggagactgtactgatattt

SEQ ID NO: 10063380 - DNA, 22 bp, Homo sapiens
ccaggagacccagggaaggagc

SEQ ID NO: 10063381 - DNA, 17 bp, Homo sapiens
ccaggagagatgcttgt

SEQ ID NO: 10063382 - DNA, 22 bp, Homo sapiens
ccaggcaacggagcccactgcc

SEQ ID NO: 10063383 - DNA, 22 bp, Homo sapiens
tgctgggatatagcttctaggg

SEQ ID NO: 10063384 - DNA, 22 bp, Homo sapiens
tgctgggattacagtcatgagc

SEQ ID NO: 10063385 - DNA, 22 bp, Homo sapiens
ccccttccttcctcagacagcc

SEQ ID NO: 10063386 - DNA, 22 bp, Homo sapiens
tggagcaggactgctgccctca

SEQ ID NO: 10063387 - DNA, 22 bp, Homo sapiens
ccctgaccatcccgcactgact

SEQ ID NO: 10063388 - DNA, 22 bp, Homo sapiens
ccctctctcaggctgacagcct

SEQ ID NO: 10063389 - DNA, 22 bp, Homo sapiens
tgcctgtgtggggtctgccgcc

SEQ ID NO: 10063390 - DNA, 22 bp, Homo sapiens
tgcctgtgtggtctgcgcatta

SEQ ID NO: 10063391 - DNA, 22 bp, Homo sapiens
tgccaggctaagtggaggactt

SEQ ID NO: 10063392 - DNA, 22 bp, Homo sapiens
tgccagctgacagcagagacaa

SEQ ID NO: 10063393 - DNA, 19 bp, Homo sapiens
cccaggctacatggagagg

SEQ ID NO: 10063394 - DNA, 22 bp, Homo sapiens
cccaggctcccaggtgggacaa

SEQ ID NO: 10063395 - DNA, 22 bp, Homo sapiens
cccaggctagaaaggccaacaa

SEQ ID NO: 10063396 - DNA, 19 bp, Homo sapiens
tggagcagggcccttgttt

SEQ ID NO: 10063397 - DNA, 22 bp, Homo sapiens
cctccaagcttcatctcaacca

SEQ ID NO: 10063398 - DNA, 18 bp, Homo sapiens
cctcagggagatccagtg

SEQ ID NO: 10063399 - DNA, 18 bp, Homo sapiens
cctcagggagagagacgc

SEQ ID NO: 10063400 - DNA, 22 bp, Homo sapiens
tggcctgggcctgccggtgcaa

SEQ ID NO: 10063401 - DNA, 22 bp, Homo sapiens
tggcctggggaagaccatgggc

SEQ ID NO: 10063402 - DNA, 22 bp, Homo sapiens
cctcaggctctgggtgcctacc

SEQ ID NO: 10063403 - DNA, 22 bp, Homo sapiens
cctcaggcctgccagagcccca

SEQ ID NO: 10063404 - DNA, 22 bp, Homo sapiens
cctcaggctgtcttccttctgg

SEQ ID NO: 10063405 - DNA, 22 bp, Homo sapiens
cctcaggcttgtgagccttcag

SEQ ID NO: 10063406 - DNA, 22 bp, Homo sapiens
tgggctggcccaccacacctcg

SEQ ID NO: 10063407 - DNA, 21 bp, Homo sapiens
cctgagcctgtttatccagaa

SEQ ID NO: 10063408 - DNA, 22 bp, Homo sapiens
tgggctggagcttgttgcttcc

SEQ ID NO: 10063409 - DNA, 22 bp, Homo sapiens
cctgagcctgcagccgagcaga

SEQ ID NO: 10063410 - DNA, 22 bp, Homo sapiens
cctctgctctggtccatgtgct

SEQ ID NO: 10063411 - DNA, 21 bp, Homo sapiens
cctctgctcgggcatgcgttt

SEQ ID NO: 10063412 - DNA, 18 bp, Homo sapiens
cctctgcctttgtagagc

SEQ ID NO: 10063413 - DNA, 22 bp, Homo sapiens
tggctgggagctggaactgggc

SEQ ID NO: 10063414 - DNA, 22 bp, Homo sapiens
ctgcaccatccttcatgctctg

SEQ ID NO: 10063415 - DNA, 22 bp, Homo sapiens
ctgcagggagcagatggcgtgt

SEQ ID NO: 10063416 - DNA, 22 bp, Homo sapiens
ctgaggccagaacccgaccctg

SEQ ID NO: 10063417 - DNA, 22 bp, Homo sapiens
ctgaggccagagtgggcctctt

SEQ ID NO: 10063418 - DNA, 22 bp, Homo sapiens
ctgaggccagctgcagagctct

SEQ ID NO: 10063419 - DNA, 22 bp, Homo sapiens
ctgaggccgtctgggtctgcag

SEQ ID NO: 10063420 - DNA, 22 bp, Homo sapiens
ctgaccagaccccaggaggctg

SEQ ID NO: 10063421 - DNA, 22 bp, Homo sapiens
ctgaggcagagggcagaccaga

SEQ ID NO: 10063422 - DNA, 22 bp, Homo sapiens
ctcttccatattactcagggta

SEQ ID NO: 10063423 - DNA, 22 bp, Homo sapiens
ctcccggctgctccggctcccg

SEQ ID NO: 10063424 - DNA, 22 bp, Homo sapiens
ctcccggcacttggcatgtcat

SEQ ID NO: 10063425 - DNA, 20 bp, Homo sapiens
ctcccctctacagagggctg

SEQ ID NO: 10063426 - DNA, 22 bp, Homo sapiens
ctctccaggagctcagagtcta

SEQ ID NO: 10063427 - DNA, 22 bp, Homo sapiens
ctctccaggctgggacaggacc

SEQ ID NO: 10063428 - DNA, 21 bp, Homo sapiens
tttcacaaaagtatgtgacaa

SEQ ID NO: 10063429 - DNA, 22 bp, Homo sapiens
ctccaagggtcttccaccagga

SEQ ID NO: 10063430 - DNA, 22 bp, Homo sapiens
ctccagcctcatctcctggctg

SEQ ID NO: 10063431 - DNA, 22 bp, Homo sapiens
cctgtctctgcagggccctgcc

SEQ ID NO: 10063432 - DNA, 22 bp, Homo sapiens
cctgggcaaatgccagagacaa

SEQ ID NO: 10063433 - DNA, 22 bp, Homo sapiens
cctgggatttgcgccagacctt

SEQ ID NO: 10063434 - DNA, 22 bp, Homo sapiens
cctgggcaacatagtgagacct

SEQ ID NO: 10063435 - DNA, 22 bp, Homo sapiens
cctgggcaacatagtgagaccc

SEQ ID NO: 10063436 - DNA, 22 bp, Homo sapiens
cctgggcaatatagtgaggccc

SEQ ID NO: 10063437 - DNA, 22 bp, Homo sapiens
tgttcagcatcaggaaagcttt

SEQ ID NO: 10063438 - DNA, 20 bp, Homo sapiens
tgttccaggaggccagggct

SEQ ID NO: 10063439 - DNA, 22 bp, Homo sapiens
cgccaggcttggtagctcatgc

SEQ ID NO: 10063440 - DNA, 23 bp, Homo sapiens
ctatggaataccaatgattctca

SEQ ID NO: 10063441 - DNA, 22 bp, Homo sapiens
gagccagggctgtgagctgagc

SEQ ID NO: 10063442 - DNA, 22 bp, Homo sapiens
gagccaggggtcagctccgagg

SEQ ID NO: 10063443 - DNA, 22 bp, Homo sapiens
gagccaggtcgggccgcggcga

SEQ ID NO: 10063444 - DNA, 16 bp, Homo sapiens
gagccaggtgccttga

SEQ ID NO: 10063445 - DNA, 22 bp, Homo sapiens
gagccaggttggaggctgcagt

SEQ ID NO: 10063446 - DNA, 22 bp, Homo sapiens
gagccaagatcgcaccactgca

SEQ ID NO: 10063447 - DNA, 22 bp, Homo sapiens
gagcctggacatctcaggccca

SEQ ID NO: 10063448 - DNA, 22 bp, Homo sapiens
gagccaggtttgaatctcagtc

SEQ ID NO: 10063449 - DNA, 22 bp, Homo sapiens
gagctaggctagggggagtcgc

SEQ ID NO: 10063450 - DNA, 22 bp, Homo sapiens
gagctaggttttccagtcgcat

SEQ ID NO: 10063451 - DNA, 22 bp, Homo sapiens
gaggagcctggccccacatcca

SEQ ID NO: 10063452 - DNA, 22 bp, Homo sapiens
gaccctggctggagctggcctg

SEQ ID NO: 10063453 - DNA, 22 bp, Homo sapiens
gacacagagataggcctgtgtt

SEQ ID NO: 10063454 - DNA, 22 bp, Homo sapiens
gacaggccaggggctgaggtgg

SEQ ID NO: 10063455 - DNA, 22 bp, Homo sapiens
gaacccaacctcacttggggta

SEQ ID NO: 10063456 - DNA, 22 bp, Homo sapiens
ctgtgccactgccccaggcctc

SEQ ID NO: 10063457 - DNA, 22 bp, Homo sapiens
ctgtgccactgggggccggcaa

SEQ ID NO: 10063458 - DNA, 22 bp, Homo sapiens
ctgtcctggggaaagccagccc

SEQ ID NO: 10063459 - DNA, 22 bp, Homo sapiens
ctgtcctgaggcaggtggcctg

SEQ ID NO: 10063460 - DNA, 23 bp, Homo sapiens
ctgtcctgccatccacagcggcc

SEQ ID NO: 10063461 - DNA, 22 bp, Homo sapiens
ctgttcagcgttggcgttaggg

SEQ ID NO: 10063462 - DNA, 22 bp, Homo sapiens
cttgtcagccaattgtggattt

SEQ ID NO: 10063463 - DNA, 22 bp, Homo sapiens
cttcagggtgacgcaggctgca

SEQ ID NO: 10063464 - DNA, 22 bp, Homo sapiens
ctgggcaggagggctctatgga

SEQ ID NO: 10063465 - DNA, 22 bp, Homo sapiens
ctgggccactccagatgcccac

SEQ ID NO: 10063466 - DNA, 19 bp, Homo sapiens
ctgggccagagctgtcctc

SEQ ID NO: 10063467 - DNA, 22 bp, Homo sapiens
ctggccaggcatcccctgatcc

SEQ ID NO: 10063468 - DNA, 22 bp, Homo sapiens
ctggccagctgacagcagggct

SEQ ID NO: 10063469 - DNA, 22 bp, Homo sapiens
ctggccagcctcccaggtaccc

SEQ ID NO: 10063470 - DNA, 22 bp, Homo sapiens
ctggcagcttcaggacactcgg

SEQ ID NO: 10063471 - DNA, 22 bp, Homo sapiens
ctgccaccatgccccagcagag

SEQ ID NO: 10063472 - DNA, 22 bp, Homo sapiens
ctggctgcctatagtctccctt

SEQ ID NO: 10063473 - DNA, 22 bp, Homo sapiens
ctggccaggccccttgcagggc

SEQ ID NO: 10063474 - DNA, 19 bp, Homo sapiens
ctggccaggccaggggccc

SEQ ID NO: 10063475 - DNA, 22 bp, Homo sapiens
gtcctggggaatacagaagccg

SEQ ID NO: 10063476 - DNA, 22 bp, Homo sapiens
gtctgcctggaggcagctgctg

SEQ ID NO: 10063477 - DNA, 22 bp, Homo sapiens
gtctgcctctattgcctacctg

SEQ ID NO: 10063478 - DNA, 17 bp, Homo sapiens
gtcctgggaggagagag

SEQ ID NO: 10063479 - DNA, 22 bp, Homo sapiens
gtcctgggcatgcagggctttc

SEQ ID NO: 10063480 - DNA, 18 bp, Homo sapiens
gtccacagccctcacagc

SEQ ID NO: 10063481 - DNA, 22 bp, Homo sapiens
gtccacagggatggccacacat

SEQ ID NO: 10063482 - DNA, 22 bp, Homo sapiens
ggggctgggatttgaacccagg

SEQ ID NO: 10063483 - DNA, 22 bp, Homo sapiens
ggggctggtggtggtttctcca

SEQ ID NO: 10063484 - DNA, 22 bp, Homo sapiens
gggccacacagaacctcctggt

SEQ ID NO: 10063485 - DNA, 22 bp, Homo sapiens
ggccatgccaggctgcctggga

SEQ ID NO: 10063486 - DNA, 22 bp, Homo sapiens
ggccatgcctggtctggcacca

SEQ ID NO: 10063487 - DNA, 19 bp, Homo sapiens
ggccaggctgactgtggtc

SEQ ID NO: 10063488 - DNA, 18 bp, Homo sapiens
ggcatgtgagtgctgagg

SEQ ID NO: 10063489 - DNA, 22 bp, Homo sapiens
ggcctgacaagtgggaagaggc

SEQ ID NO: 10063490 - DNA, 22 bp, Homo sapiens
ggcctgacatttgcatcaacac

SEQ ID NO: 10063491 - DNA, 22 bp, Homo sapiens
ggcctgactaatcaggatgaat

SEQ ID NO: 10063492 - DNA, 22 bp, Homo sapiens
ggcctgactgacctgattctaa

SEQ ID NO: 10063493 - DNA, 22 bp, Homo sapiens
ggcctgacttgatcggctctct

SEQ ID NO: 10063494 - DNA, 21 bp, Homo sapiens
ggcctcagccacctggctctg

SEQ ID NO: 10063495 - DNA, 23 bp, Homo sapiens
ggcctcagcgcacagaaactgct

SEQ ID NO: 10063496 - DNA, 22 bp, Homo sapiens
ggctgacctcgcccctacatct

SEQ ID NO: 10063497 - DNA, 22 bp, Homo sapiens
ggctgggaggccgtgctgacct

SEQ ID NO: 10063498 - DNA, 21 bp, Homo sapiens
ggctgggcaggacccacccct

SEQ ID NO: 10063499 - DNA, 22 bp, Homo sapiens
ggctgggcctctccctcagctg

SEQ ID NO: 10063500 - DNA, 22 bp, Homo sapiens
ggctgggccgcggctacccaga

SEQ ID NO: 10063501 - DNA, 22 bp, Homo sapiens
ggctgggctgcggctgtacctg

SEQ ID NO: 10063502 - DNA, 22 bp, Homo sapiens
gggcacagctgctacccagtgc

SEQ ID NO: 10063503 - DNA, 22 bp, Homo sapiens
gggagacccccaatgccaggtc

SEQ ID NO: 10063504 - DNA, 22 bp, Homo sapiens
gcagcccagagcgcaggacccc

SEQ ID NO: 10063505 - DNA, 22 bp, Homo sapiens
gcagcccaggaccctggacaga

SEQ ID NO: 10063506 - DNA, 22 bp, Homo sapiens
gcagggctgttcaggagggtgg

SEQ ID NO: 10063507 - DNA, 22 bp, Homo sapiens
gcagggctggggctgctcctga

SEQ ID NO: 10063508 - DNA, 22 bp, Homo sapiens
gcagggctgaaggtcccaggcc

SEQ ID NO: 10063509 - DNA, 22 bp, Homo sapiens
gcagaggcagggccctcctcca

SEQ ID NO: 10063510 - DNA, 22 bp, Homo sapiens
gcagaggcatttctgacgctgc

SEQ ID NO: 10063511 - DNA, 22 bp, Homo sapiens
gcagactgtacctggaagaggg

SEQ ID NO: 10063512 - DNA, 22 bp, Homo sapiens
gccagggtcctgaagaccaagt

SEQ ID NO: 10063513 - DNA, 22 bp, Homo sapiens
gccagggtggcagaaggcccca

SEQ ID NO: 10063514 - DNA, 22 bp, Homo sapiens
gccagggtgagggctgagaggt

SEQ ID NO: 10063515 - DNA, 22 bp, Homo sapiens
gcccagccctgaggtcacagct

SEQ ID NO: 10063516 - DNA, 22 bp, Homo sapiens
gccagggcaggggagcatctgc

SEQ ID NO: 10063517 - DNA, 22 bp, Homo sapiens
gccagggctgtgcaggtttgtt

SEQ ID NO: 10063518 - DNA, 22 bp, Homo sapiens
gccaggcaggccacgctgtgtt

SEQ ID NO: 10063519 - DNA, 22 bp, Homo sapiens
gccttgggcacaggcagggccc

SEQ ID NO: 10063520 - DNA, 22 bp, Homo sapiens
gctcccactgcagccctgagcc

SEQ ID NO: 10063521 - DNA, 21 bp, Homo sapiens
gctcagagtattgcactgttt

SEQ ID NO: 10063522 - DNA, 23 bp, Homo sapiens
gctcagcctcagcaggcccagga

SEQ ID NO: 10063523 - DNA, 22 bp, Homo sapiens
gctcagccgaacttcagagcag

SEQ ID NO: 10063524 - DNA, 22 bp, Homo sapiens
gctgcctgtggcccttctgggt

SEQ ID NO: 10063525 - DNA, 22 bp, Homo sapiens
gctgcctgtgtggccactcact

SEQ ID NO: 10063526 - DNA, 22 bp, Homo sapiens
gctgcctgttgaagggtctgtg

SEQ ID NO: 10063527 - DNA, 22 bp, Homo sapiens
gctgcctgtgcactttctcgta

SEQ ID NO: 10063528 - DNA, 19 bp, Homo sapiens
gctgcctgtcttagccagt

SEQ ID NO: 10063529 - DNA, 22 bp, Homo sapiens
gctgcctgtgcgggtcgctagg

SEQ ID NO: 10063530 - DNA, 22 bp, Homo sapiens
gctgcctgtctgtttcttttat

SEQ ID NO: 10063531 - DNA, 22 bp, Homo sapiens
gctgcctgtctgctgacccagg

SEQ ID NO: 10063532 - DNA, 20 bp, Homo sapiens
gctgcctgtttctgtaagta

SEQ ID NO: 10063533 - DNA, 22 bp, Homo sapiens
gctgctccagctgtgctgcaga

SEQ ID NO: 10063534 - DNA, 19 bp, Homo sapiens
gctgctcctggctgaccac

SEQ ID NO: 10063535 - DNA, 22 bp, Homo sapiens
gctgcctgtcctgaggagtccg

SEQ ID NO: 10063536 - DNA, 22 bp, Homo sapiens
gctgaggctcaagtcatgggtc

SEQ ID NO: 10063537 - DNA, 22 bp, Homo sapiens
gctcctccctgtgcagacccag

SEQ ID NO: 10063538 - DNA, 22 bp, Homo sapiens
gctcctccaatatggactcctc

SEQ ID NO: 10063539 - DNA, 22 bp, Homo sapiens
gctgggaacacagccatgagag

SEQ ID NO: 10063540 - DNA, 22 bp, Homo sapiens
ggacacagggctcactctctct

SEQ ID NO: 10063541 - DNA, 22 bp, Homo sapiens
tcagcactttgaagcagaagga

SEQ ID NO: 10063542 - DNA, 22 bp, Homo sapiens
tcagcacttggatttcagagat

SEQ ID NO: 10063543 - DNA, 21 bp, Homo sapiens
tcagcagcttttgcagtccct

SEQ ID NO: 10063544 - DNA, 22 bp, Homo sapiens
tcagtgtgttactttctcctat

SEQ ID NO: 10063545 - DNA, 22 bp, Homo sapiens
tcagagccaatcatggtgcatt

SEQ ID NO: 10063546 - DNA, 22 bp, Homo sapiens
tcagagccctgctcctccccaa

SEQ ID NO: 10063547 - DNA, 22 bp, Homo sapiens
tcagagcttatctcttgctgga

SEQ ID NO: 10063548 - DNA, 22 bp, Homo sapiens
tcagagctcctaagggctgatt

SEQ ID NO: 10063549 - DNA, 22 bp, Homo sapiens
tcagagctttggagaccaggaa

SEQ ID NO: 10063550 - DNA, 22 bp, Homo sapiens
tcagcactggcgctgggcaggt

SEQ ID NO: 10063551 - DNA, 22 bp, Homo sapiens
tccagggcagggtgcgcatggg

SEQ ID NO: 10063552 - DNA, 19 bp, Homo sapiens
tccagggcaggaacatgta

SEQ ID NO: 10063553 - DNA, 22 bp, Homo sapiens
tccagggccacagaggatgcta

SEQ ID NO: 10063554 - DNA, 22 bp, Homo sapiens
tccaggagtgataaggccactg

SEQ ID NO: 10063555 - DNA, 21 bp, Homo sapiens
tccaggagtggctgggcaggg

SEQ ID NO: 10063556 - DNA, 22 bp, Homo sapiens
tccaggcagggttaagggtcct

SEQ ID NO: 10063557 - DNA, 22 bp, Homo sapiens
tccaggaggtatgagtggcccc

SEQ ID NO: 10063558 - DNA, 22 bp, Homo sapiens
tccaggagggttttctgccttc

SEQ ID NO: 10063559 - DNA, 22 bp, Homo sapiens
tccaggagggggagccgtgccg

SEQ ID NO: 10063560 - DNA, 22 bp, Homo sapiens
tccaggaggtttggaggaagca

SEQ ID NO: 10063561 - DNA, 22 bp, Homo sapiens
tccaggcatcccccaggacaga

SEQ ID NO: 10063562 - DNA, 22 bp, Homo sapiens
tccaggccacatggatggcgat

SEQ ID NO: 10063563 - DNA, 22 bp, Homo sapiens
tccaggccacgacctcctggat

SEQ ID NO: 10063564 - DNA, 22 bp, Homo sapiens
tccaggccactgcagaggctct

SEQ ID NO: 10063565 - DNA, 22 bp, Homo sapiens
tccaggctgcaaggccacaggg

SEQ ID NO: 10063566 - DNA, 22 bp, Homo sapiens
tccagagctgggtctgtgctca

SEQ ID NO: 10063567 - DNA, 22 bp, Homo sapiens
tccagagctgagggtcagtaga

SEQ ID NO: 10063568 - DNA, 22 bp, Homo sapiens
tccagagctctgggcatagctg

SEQ ID NO: 10063569 - DNA, 23 bp, Homo sapiens
tccagagctcatgctctcaacca

SEQ ID NO: 10063570 - DNA, 18 bp, Homo sapiens
tccagagctggtgcttct

SEQ ID NO: 10063571 - DNA, 17 bp, Homo sapiens
tccagagcacagagctc

SEQ ID NO: 10063572 - DNA, 22 bp, Homo sapiens
tccagagcaggtggtcagaagg

SEQ ID NO: 10063573 - DNA, 22 bp, Homo sapiens
tccagagcatgcagatcatcaa

SEQ ID NO: 10063574 - DNA, 22 bp, Homo sapiens
tccagagcctgcgcactggctg

SEQ ID NO: 10063575 - DNA, 22 bp, Homo sapiens
tccagagcctttctgcttgaca

SEQ ID NO: 10063576 - DNA, 22 bp, Homo sapiens
tccagagccttcgataagaaga

SEQ ID NO: 10063577 - DNA, 22 bp, Homo sapiens
tccagagctaattcagcagctg

SEQ ID NO: 10063578 - DNA, 18 bp, Homo sapiens
tccagagctactgtggtg

SEQ ID NO: 10063579 - DNA, 22 bp, Homo sapiens
tccagagctacttgctcaactt

SEQ ID NO: 10063580 - DNA, 22 bp, Homo sapiens
gttcaggaagtctcagctggga

SEQ ID NO: 10063581 - DNA, 22 bp, Homo sapiens
gttcagagaaagagacacctta

SEQ ID NO: 10063582 - DNA, 22 bp, Homo sapiens
gtgctcaggttcccatgagtgc

SEQ ID NO: 10063583 - DNA, 22 bp, Homo sapiens
gtgtgccaccagtcaaggtgaa

SEQ ID NO: 10063584 - DNA, 22 bp, Homo sapiens
gtgtgccaggaactggctgctg

SEQ ID NO: 10063585 - DNA, 22 bp, Homo sapiens
tacaggagctgctctgtgatac

SEQ ID NO: 10063586 - DNA, 22 bp, Homo sapiens
tacaggagcacaaaagagttga

SEQ ID NO: 10063587 - DNA, 19 bp, Homo sapiens
tacaggaggcctgcaatct

SEQ ID NO: 10063588 - DNA, 22 bp, Homo sapiens
tacaggaggattatcaaaggat

SEQ ID NO: 10063589 - DNA, 22 bp, Homo sapiens
ttcctctggggccaggccaaca

SEQ ID NO: 10063590 - DNA, 22 bp, Homo sapiens
ttccagagcccatgctctaggc

SEQ ID NO: 10063591 - DNA, 22 bp, Homo sapiens
ttccagagctttgcgcttggaa

SEQ ID NO: 10063592 - DNA, 22 bp, Homo sapiens
tgtggcagtctcactggagggc

SEQ ID NO: 10063593 - DNA, 22 bp, Homo sapiens
tcccctgcagatgagggcagtg

SEQ ID NO: 10063594 - DNA, 22 bp, Homo sapiens
tgttctggagataagaggtaga

SEQ ID NO: 10063595 - DNA, 23 bp, Homo sapiens
tttgttcactcctgggaaagaca

SEQ ID NO: 10063596 - DNA, 22 bp, Homo sapiens
ctgctgccaagggtgccacagg

SEQ ID NO: 10063597 - DNA, 22 bp, Homo sapiens
ctggctcccgaagccctcagtg

SEQ ID NO: 10063598 - DNA, 20 bp, Homo sapiens
ctggcccatctaccgctctg

SEQ ID NO: 10063599 - DNA, 22 bp, Homo sapiens
ctggcccattgccttctctctc

SEQ ID NO: 10063600 - DNA, 22 bp, Homo sapiens
ctgctgatgacctcaaactctt

SEQ ID NO: 10063601 - DNA, 22 bp, Homo sapiens
ctgctgatcgaatcagtcaccc

SEQ ID NO: 10063602 - DNA, 22 bp, Homo sapiens
ctgcctctcagcctgaccgcca

SEQ ID NO: 10063603 - DNA, 21 bp, Homo sapiens
cttcccaaggcttcaaagcct

SEQ ID NO: 10063604 - DNA, 22 bp, Homo sapiens
cttcttgcaattttcatcttat

SEQ ID NO: 10063605 - DNA, 22 bp, Homo sapiens
cttcttgctgggggcctcagtg

SEQ ID NO: 10063606 - DNA, 22 bp, Homo sapiens
cttcttggaagtcgtccttcca

SEQ ID NO: 10063607 - DNA, 22 bp, Homo sapiens
cttcttgggctgccagtttcag

SEQ ID NO: 10063608 - DNA, 22 bp, Homo sapiens
cttcttgtatctgccgccgagc

SEQ ID NO: 10063609 - DNA, 22 bp, Homo sapiens
cttcttggttggtttcattcca

SEQ ID NO: 10063610 - DNA, 22 bp, Homo sapiens
cttcttgtaaacggttccccga

SEQ ID NO: 10063611 - DNA, 23 bp, Homo sapiens
atctgaaaaggcattttcttccc

SEQ ID NO: 10063612 - DNA, 22 bp, Homo sapiens
cttcctcctccatctcgaaggc

SEQ ID NO: 10063613 - DNA, 22 bp, Homo sapiens
atcagaatcttctgaacagtgg

SEQ ID NO: 10063614 - DNA, 22 bp, Homo sapiens
atcagagaccggtcaagtcatg

SEQ ID NO: 10063615 - DNA, 22 bp, Homo sapiens
atcagagaaatggagggcgctt

SEQ ID NO: 10063616 - DNA, 22 bp, Homo sapiens
atcagagattgtagtatgtgca

SEQ ID NO: 10063617 - DNA, 22 bp, Homo sapiens
ctgtgggaacactgaggacttc

SEQ ID NO: 10063618 - DNA, 22 bp, Homo sapiens
atccaggctgggtgtggctact

SEQ ID NO: 10063619 - DNA, 22 bp, Homo sapiens
atccaggctgtctaatgggaga

SEQ ID NO: 10063620 - DNA, 22 bp, Homo sapiens
atccaggctggagtgcattggt

SEQ ID NO: 10063621 - DNA, 22 bp, Homo sapiens
atccaggctgctatgaggatga

SEQ ID NO: 10063622 - DNA, 22 bp, Homo sapiens
atccaggctgctttctatgccc

SEQ ID NO: 10063623 - DNA, 22 bp, Homo sapiens
atccaggcgaatgcagaaggcc

SEQ ID NO: 10063624 - DNA, 22 bp, Homo sapiens
atccaggctgcgggtctcaagt

SEQ ID NO: 10063625 - DNA, 22 bp, Homo sapiens
atccaggcttcagctgcctact

SEQ ID NO: 10063626 - DNA, 22 bp, Homo sapiens
atccaggcttaatgggagccac

SEQ ID NO: 10063627 - DNA, 22 bp, Homo sapiens
atccaggcctgagtctggtcct

SEQ ID NO: 10063628 - DNA, 22 bp, Homo sapiens
atccaggccccaagaccccgac

SEQ ID NO: 10063629 - DNA, 22 bp, Homo sapiens
atccaggccttgaagtaccagt

SEQ ID NO: 10063630 - DNA, 19 bp, Homo sapiens
atcaaagactgcaggattt

SEQ ID NO: 10063631 - DNA, 22 bp, Homo sapiens
atcagaaggggaggtaaagaag

SEQ ID NO: 10063632 - DNA, 20 bp, Homo sapiens
atcagaagtgatattaacca

SEQ ID NO: 10063633 - DNA, 21 bp, Homo sapiens
atcagaatctctagatttgga

SEQ ID NO: 10063634 - DNA, 22 bp, Homo sapiens
atcagaataattagatttcaga

SEQ ID NO: 10063635 - DNA, 22 bp, Homo sapiens
ctgggctgagctgtggaaactc

SEQ ID NO: 10063636 - DNA, 22 bp, Homo sapiens
ctgagcagcagggagactggtg

SEQ ID NO: 10063637 - DNA, 22 bp, Homo sapiens
ctgagcagatgaccagccccag

SEQ ID NO: 10063638 - DNA, 22 bp, Homo sapiens
ctgagcagcacagggcgccagg

SEQ ID NO: 10063639 - DNA, 22 bp, Homo sapiens
ctgagcagcaacccagagcctc

SEQ ID NO: 10063640 - DNA, 22 bp, Homo sapiens
ctgagcagcaattgctggccca

SEQ ID NO: 10063641 - DNA, 22 bp, Homo sapiens
ctctgcaggccttgagtgtggt

SEQ ID NO: 10063642 - DNA, 22 bp, Homo sapiens
ctctgcctgccactgttcaggc

SEQ ID NO: 10063643 - DNA, 22 bp, Homo sapiens
ctctgcctgtctcatcctgcaa

SEQ ID NO: 10063644 - DNA, 22 bp, Homo sapiens
ctctgcctgcccaccgacccat

SEQ ID NO: 10063645 - DNA, 22 bp, Homo sapiens
ctctgcctgtgtcgccaccaca

SEQ ID NO: 10063646 - DNA, 22 bp, Homo sapiens
ctctggctttgctcatgcatcc

SEQ ID NO: 10063647 - DNA, 22 bp, Homo sapiens
ctcctggggcacttagaagcaa

SEQ ID NO: 10063648 - DNA, 22 bp, Homo sapiens
ctcctggggccatggaaggaac

SEQ ID NO: 10063649 - DNA, 22 bp, Homo sapiens
ctcctgggaaaggctggacaca

SEQ ID NO: 10063650 - DNA, 20 bp, Homo sapiens
ctcctgggactgctggttat

SEQ ID NO: 10063651 - DNA, 22 bp, Homo sapiens
agtggcagagttgaataattga

SEQ ID NO: 10063652 - DNA, 22 bp, Homo sapiens
ctctcagaagtagcacgtgggc

SEQ ID NO: 10063653 - DNA, 22 bp, Homo sapiens
agtggcagaagccaagtctgca

SEQ ID NO: 10063654 - DNA, 22 bp, Homo sapiens
ctcccaggttgattctttccct

SEQ ID NO: 10063655 - DNA, 22 bp, Homo sapiens
ctccctcagaggagcacctgtt

SEQ ID NO: 10063656 - DNA, 22 bp, Homo sapiens
ctcctcactttccagactgggc

SEQ ID NO: 10063657 - DNA, 22 bp, Homo sapiens
agtcctcccttggggccacctt

SEQ ID NO: 10063658 - DNA, 22 bp, Homo sapiens
ctcatgtcttcacccattctaa

SEQ ID NO: 10063659 - DNA, 22 bp, Homo sapiens
ctccagagatacacggtcttgc

SEQ ID NO: 10063660 - DNA, 22 bp, Homo sapiens
ctccaggaaaatagggaatgag

SEQ ID NO: 10063661 - DNA, 22 bp, Homo sapiens
ctccaggcttcaagggccggcc

SEQ ID NO: 10063662 - DNA, 22 bp, Homo sapiens
ctccaggctggggtgcaggttg

SEQ ID NO: 10063663 - DNA, 22 bp, Homo sapiens
ctccaggaaagtcaggcttaga

SEQ ID NO: 10063664 - DNA, 22 bp, Homo sapiens
ctccaggcgggaggcggttcca

SEQ ID NO: 10063665 - DNA, 22 bp, Homo sapiens
ctccaggctcgtccaagatcga

SEQ ID NO: 10063666 - DNA, 22 bp, Homo sapiens
ctccaggctggatccaagtcaa

SEQ ID NO: 10063667 - DNA, 20 bp, Homo sapiens
cctgggctccaggagccccg

SEQ ID NO: 10063668 - DNA, 22 bp, Homo sapiens
cctgtcccccaggcctgtacca

SEQ ID NO: 10063669 - DNA, 22 bp, Homo sapiens
cggctcagctagcttggcccca

SEQ ID NO: 10063670 - DNA, 17 bp, Homo sapiens
cgggcatggagggcagg

SEQ ID NO: 10063671 - DNA, 22 bp, Homo sapiens
aggggctcctggcctggagagc

SEQ ID NO: 10063672 - DNA, 22 bp, Homo sapiens
aggggcgtgctcttccccgacg

SEQ ID NO: 10063673 - DNA, 22 bp, Homo sapiens
aggggggtggatcacctgaggt

SEQ ID NO: 10063674 - DNA, 22 bp, Homo sapiens
agggggtctcctatcatggaag

SEQ ID NO: 10063675 - DNA, 22 bp, Homo sapiens
aggggtagtaggataacaaatt

SEQ ID NO: 10063676 - DNA, 16 bp, Homo sapiens
aggggtacagttcatc

SEQ ID NO: 10063677 - DNA, 22 bp, Homo sapiens
cctcaggggtgcccacagctgc

SEQ ID NO: 10063678 - DNA, 22 bp, Homo sapiens
cctcagggtctctcacagcacc

SEQ ID NO: 10063679 - DNA, 22 bp, Homo sapiens
cctcagggtcatcctagtaata

SEQ ID NO: 10063680 - DNA, 22 bp, Homo sapiens
agggcccagtggagagctgagc

SEQ ID NO: 10063681 - DNA, 22 bp, Homo sapiens
agggaccctgatgactgaggag

SEQ ID NO: 10063682 - DNA, 22 bp, Homo sapiens
agggaaaggtagtgaggtcaca

SEQ ID NO: 10063683 - DNA, 22 bp, Homo sapiens
cccaggaagtggaggttgcagt

SEQ ID NO: 10063684 - DNA, 22 bp, Homo sapiens
cccaggaagggatgccaaggaa

SEQ ID NO: 10063685 - DNA, 22 bp, Homo sapiens
cccaggaagagtgagtggcatt

SEQ ID NO: 10063686 - DNA, 19 bp, Homo sapiens
cccaggaagcggaggttgc

SEQ ID NO: 10063687 - DNA, 22 bp, Homo sapiens
cccagtaatcggagagtactta

SEQ ID NO: 10063688 - DNA, 20 bp, Homo sapiens
agggcacttttgctggagca

SEQ ID NO: 10063689 - DNA, 22 bp, Homo sapiens
cccagtaagaagctggcaccag

SEQ ID NO: 10063690 - DNA, 22 bp, Homo sapiens
cccaggtgggcacctcgaggaa

SEQ ID NO: 10063691 - DNA, 22 bp, Homo sapiens
agggcagaccacgtgcaaggat

SEQ ID NO: 10063692 - DNA, 22 bp, Homo sapiens
cccctgccagctatccctgaac

SEQ ID NO: 10063693 - DNA, 22 bp, Homo sapiens
ccagccagctgcccttggggcc

SEQ ID NO: 10063694 - DNA, 22 bp, Homo sapiens
ccactcccttccggtccagggc

SEQ ID NO: 10063695 - DNA, 22 bp, Homo sapiens
ccaggcacggtggctcatgcct

SEQ ID NO: 10063696 - DNA, 20 bp, Homo sapiens
aggctcagatacccagggaa

SEQ ID NO: 10063697 - DNA, 22 bp, Homo sapiens
aggctcagaggtgagcatctgc

SEQ ID NO: 10063698 - DNA, 16 bp, Homo sapiens
aggctcagaggctgga

SEQ ID NO: 10063699 - DNA, 20 bp, Homo sapiens
aggctcagagcagtagtaca

SEQ ID NO: 10063700 - DNA, 22 bp, Homo sapiens
aggctcagagagctgtgtccat

SEQ ID NO: 10063701 - DNA, 21 bp, Homo sapiens
aggctcagagagaaactcttg

SEQ ID NO: 10063702 - DNA, 21 bp, Homo sapiens
aggctcagagatcaaacagta

SEQ ID NO: 10063703 - DNA, 22 bp, Homo sapiens
aggctcagagatgagtaagcac

SEQ ID NO: 10063704 - DNA, 22 bp, Homo sapiens
ccaggagggtggttactcaatc

SEQ ID NO: 10063705 - DNA, 22 bp, Homo sapiens
ccaggaggatgaggggcataga

SEQ ID NO: 10063706 - DNA, 22 bp, Homo sapiens
ccaggagggaggagttcctgag

SEQ ID NO: 10063707 - DNA, 22 bp, Homo sapiens
ccagggcagcagaattggggca

SEQ ID NO: 10063708 - DNA, 22 bp, Homo sapiens
ccagggcagccaacccagatgc

SEQ ID NO: 10063709 - DNA, 22 bp, Homo sapiens
ccagggcagcgcccctccacgc

SEQ ID NO: 10063710 - DNA, 22 bp, Homo sapiens
ccagggcagaaaaagagggaat

SEQ ID NO: 10063711 - DNA, 22 bp, Homo sapiens
ccagggcacttaggcccagccc

SEQ ID NO: 10063712 - DNA, 22 bp, Homo sapiens
aggctcagattcacatttggtt

SEQ ID NO: 10063713 - DNA, 22 bp, Homo sapiens
aggctcagatccttgtgtcctg

SEQ ID NO: 10063714 - DNA, 22 bp, Homo sapiens
aggctcagcctgggcctagagc

SEQ ID NO: 10063715 - DNA, 22 bp, Homo sapiens
aggctcagcccctgggaggaga

SEQ ID NO: 10063716 - DNA, 21 bp, Homo sapiens
aggctcagcaggtgtataaag

SEQ ID NO: 10063717 - DNA, 22 bp, Homo sapiens
aggctcagcatctgattcatat

SEQ ID NO: 10063718 - DNA, 22 bp, Homo sapiens
aggctcagcccaaggtggagag

SEQ ID NO: 10063719 - DNA, 21 bp, Homo sapiens
cccacggaatgatgaggcact

SEQ ID NO: 10063720 - DNA, 22 bp, Homo sapiens
cccacctctcagagagccttgc

SEQ ID NO: 10063721 - DNA, 22 bp, Homo sapiens
cccactccctgcacgcctgccg

SEQ ID NO: 10063722 - DNA, 22 bp, Homo sapiens
cccactcctggagctagggctc

SEQ ID NO: 10063723 - DNA, 22 bp, Homo sapiens
caggcagcctgcggtctgcaca

SEQ ID NO: 10063724 - DNA, 22 bp, Homo sapiens
caggcagcgctcgtggcctggc

SEQ ID NO: 10063725 - DNA, 22 bp, Homo sapiens
agctgtctctggtattatgtga

SEQ ID NO: 10063726 - DNA, 22 bp, Homo sapiens
agctgtctctctggtgtccata

SEQ ID NO: 10063727 - DNA, 22 bp, Homo sapiens
agctgtctttcattacctcatt

SEQ ID NO: 10063728 - DNA, 22 bp, Homo sapiens
caggagccacattccaccttga

SEQ ID NO: 10063729 - DNA, 22 bp, Homo sapiens
caggagccagctgtcccaacca

SEQ ID NO: 10063730 - DNA, 20 bp, Homo sapiens
caggcacactcattcctgct

SEQ ID NO: 10063731 - DNA, 20 bp, Homo sapiens
cagggctctgggcctggcct

SEQ ID NO: 10063732 - DNA, 22 bp, Homo sapiens
cagggcttgaatcaaggaagtc

SEQ ID NO: 10063733 - DNA, 22 bp, Homo sapiens
caggtgggattttgctgcttga

SEQ ID NO: 10063734 - DNA, 22 bp, Homo sapiens
cagggcttcgtgtctcagtgct

SEQ ID NO: 10063735 - DNA, 23 bp, Homo sapiens
aggacagcaaaccccgcctcccc

SEQ ID NO: 10063736 - DNA, 22 bp, Homo sapiens
aggagccagttccaccccagga

SEQ ID NO: 10063737 - DNA, 22 bp, Homo sapiens
aggaggcctacgcacatgtcta

SEQ ID NO: 10063738 - DNA, 22 bp, Homo sapiens
aggagctgtcagagtgccagag

SEQ ID NO: 10063739 - DNA, 16 bp, Homo sapiens
aggagctgggtaggag

SEQ ID NO: 10063740 - DNA, 17 bp, Homo sapiens
aggagctgggggtggtg

SEQ ID NO: 10063741 - DNA, 22 bp, Homo sapiens
aggagccagattctctcacttt

SEQ ID NO: 10063742 - DNA, 23 bp, Homo sapiens
aggagccagccctgttctcagta

SEQ ID NO: 10063743 - DNA, 22 bp, Homo sapiens
aggagccacttaggtgagataa

SEQ ID NO: 10063744 - DNA, 20 bp, Homo sapiens
cagtccaggctgcagcatct

SEQ ID NO: 10063745 - DNA, 22 bp, Homo sapiens
cagtccaggcctggaggagcca

SEQ ID NO: 10063746 - DNA, 22 bp, Homo sapiens
aggaggcctgttttctcctgga

SEQ ID NO: 10063747 - DNA, 20 bp, Homo sapiens
catctcctgcctccatgttc

SEQ ID NO: 10063748 - DNA, 21 bp, Homo sapiens
ccaccaggtcttctgctcggg

SEQ ID NO: 10063749 - DNA, 22 bp, Homo sapiens
ccaccaggctctgtccgagcgg

SEQ ID NO: 10063750 - DNA, 22 bp, Homo sapiens
ggctggtgttacagtcggcagc

SEQ ID NO: 10063751 - DNA, 22 bp, Homo sapiens
cagaaaagggtgtttgttcagg

SEQ ID NO: 10063752 - DNA, 22 bp, Homo sapiens
ggcctgtgcacatgtgcaggaa

SEQ ID NO: 10063753 - DNA, 22 bp, Homo sapiens
ggcctgtgagcccttgcatgta

SEQ ID NO: 10063754 - DNA, 22 bp, Homo sapiens
ggcctgtgctgagaacctggct

SEQ ID NO: 10063755 - DNA, 22 bp, Homo sapiens
ggcaggtgcccagagagcacga

SEQ ID NO: 10063756 - DNA, 22 bp, Homo sapiens
caaggcctcctgggcccagaga

SEQ ID NO: 10063757 - DNA, 22 bp, Homo sapiens
gctggaggaggaagtgtgaggg

SEQ ID NO: 10063758 - DNA, 22 bp, Homo sapiens
gctggaggatggactggaagaa

SEQ ID NO: 10063759 - DNA, 22 bp, Homo sapiens
gctgtggcctggcgcagagctg

SEQ ID NO: 10063760 - DNA, 22 bp, Homo sapiens
caaggtaagcgagagatgaggt

SEQ ID NO: 10063761 - DNA, 22 bp, Homo sapiens
ggaggcattatggggaagactt

SEQ ID NO: 10063762 - DNA, 22 bp, Homo sapiens
ggagcctgcgggagctcccatt

SEQ ID NO: 10063763 - DNA, 22 bp, Homo sapiens
cacagaggaaaggcagttggta

SEQ ID NO: 10063764 - DNA, 22 bp, Homo sapiens
cacagagctcaagtcttagaaa

SEQ ID NO: 10063765 - DNA, 22 bp, Homo sapiens
cacagagctgaacctgggtcat

SEQ ID NO: 10063766 - DNA, 22 bp, Homo sapiens
cacagagctggaaaggctgggc

SEQ ID NO: 10063767 - DNA, 22 bp, Homo sapiens
ggactgggattctggatctgct

SEQ ID NO: 10063768 - DNA, 22 bp, Homo sapiens
ggactgggcatgggtgctctgc

SEQ ID NO: 10063769 - DNA, 17 bp, Homo sapiens
ggactgggcggggcagg

SEQ ID NO: 10063770 - DNA, 22 bp, Homo sapiens
ggactgggccaggggttggact

SEQ ID NO: 10063771 - DNA, 22 bp, Homo sapiens
cacagaagaatcatgctgtgtt

SEQ ID NO: 10063772 - DNA, 22 bp, Homo sapiens
ggggagaccatctgaaggtgat

SEQ ID NO: 10063773 - DNA, 22 bp, Homo sapiens
ggggagcaatagttgaggtgtg

SEQ ID NO: 10063774 - DNA, 22 bp, Homo sapiens
ggggagcttagggtctctgaat

SEQ ID NO: 10063775 - DNA, 22 bp, Homo sapiens
ggtcagggttccaggtatcttc

SEQ ID NO: 10063776 - DNA, 22 bp, Homo sapiens
cagcaagacagtttcctaagtg

SEQ ID NO: 10063777 - DNA, 22 bp, Homo sapiens
cagcacagtacaaggcacggat

SEQ ID NO: 10063778 - DNA, 21 bp, Homo sapiens
cagcacagtactgggtcttgc

SEQ ID NO: 10063779 - DNA, 22 bp, Homo sapiens
cagcacacagtgactcgcacct

SEQ ID NO: 10063780 - DNA, 22 bp, Homo sapiens
cagcacagtgcagatgctgact

SEQ ID NO: 10063781 - DNA, 22 bp, Homo sapiens
cagcacagtttctggcccgccg

SEQ ID NO: 10063782 - DNA, 22 bp, Homo sapiens
cagcacagtagagtagttgtaa

SEQ ID NO: 10063783 - DNA, 22 bp, Homo sapiens
cagcacagtttgcttggcagag

SEQ ID NO: 10063784 - DNA, 22 bp, Homo sapiens
gggcagagaaatggacagttgg

SEQ ID NO: 10063785 - DNA, 22 bp, Homo sapiens
gggcagcagttgccctaatcaa

SEQ ID NO: 10063786 - DNA, 22 bp, Homo sapiens
gggcagtgggaccaggcaccag

SEQ ID NO: 10063787 - DNA, 22 bp, Homo sapiens
gggcagtggttacacagctgag

SEQ ID NO: 10063788 - DNA, 22 bp, Homo sapiens
gggcagtggtccaggctacagc

SEQ ID NO: 10063789 - DNA, 22 bp, Homo sapiens
gggcagtgggtggctgcagcct

SEQ ID NO: 10063790 - DNA, 22 bp, Homo sapiens
cagagcctaaaacgactccact

SEQ ID NO: 10063791 - DNA, 19 bp, Homo sapiens
cagagcctcagagctagaa

SEQ ID NO: 10063792 - DNA, 22 bp, Homo sapiens
cagagcctccctcctctgccat

SEQ ID NO: 10063793 - DNA, 22 bp, Homo sapiens
cagagcctctaaaatttctatc

SEQ ID NO: 10063794 - DNA, 22 bp, Homo sapiens
cagagcctctcagccccttggg

SEQ ID NO: 10063795 - DNA, 22 bp, Homo sapiens
cagagcctctgccctgggcact

SEQ ID NO: 10063796 - DNA, 22 bp, Homo sapiens
cagagcctgcctctggctgtgg

SEQ ID NO: 10063797 - DNA, 22 bp, Homo sapiens
cagcacctacccatcctgagtc

SEQ ID NO: 10063798 - DNA, 22 bp, Homo sapiens
cagcacctctgggtcttgtctt

SEQ ID NO: 10063799 - DNA, 22 bp, Homo sapiens
cagcacctgctcttagacacgg

SEQ ID NO: 10063800 - DNA, 22 bp, Homo sapiens
cagcacctaggacagtagtcag

SEQ ID NO: 10063801 - DNA, 22 bp, Homo sapiens
cagcacctccgcagttcacctg

SEQ ID NO: 10063802 - DNA, 22 bp, Homo sapiens
cagcagctgcctcagctgggga

SEQ ID NO: 10063803 - DNA, 22 bp, Homo sapiens
gtcatcactggtagcaaagatt

SEQ ID NO: 10063804 - DNA, 22 bp, Homo sapiens
gtcccaggaacattctggctag

SEQ ID NO: 10063805 - DNA, 22 bp, Homo sapiens
gtcccaggcaggccactggcag

SEQ ID NO: 10063806 - DNA, 22 bp, Homo sapiens
gtcccaggctccatggcagcca

SEQ ID NO: 10063807 - DNA, 22 bp, Homo sapiens
gtcccaggagttgctgggcctt

SEQ ID NO: 10063808 - DNA, 22 bp, Homo sapiens
gtcccaggcagagtcaggaggg

SEQ ID NO: 10063809 - DNA, 22 bp, Homo sapiens
cagccaggcccccgagtcgttg

SEQ ID NO: 10063810 - DNA, 22 bp, Homo sapiens
gtcccagggaagaaggcagcac

SEQ ID NO: 10063811 - DNA, 22 bp, Homo sapiens
gtcccaggcttatgtggagctt

SEQ ID NO: 10063812 - DNA, 22 bp, Homo sapiens
cagccagggagggcaaatgaga

SEQ ID NO: 10063813 - DNA, 22 bp, Homo sapiens
cagcccaggctcagatgttggg

SEQ ID NO: 10063814 - DNA, 21 bp, Homo sapiens
cagcctgctgctccagggcca

SEQ ID NO: 10063815 - DNA, 23 bp, Homo sapiens
gctgactgtgaaattctggagct

SEQ ID NO: 10063816 - DNA, 22 bp, Homo sapiens
caaagcagagaactgtctcatt

SEQ ID NO: 10063817 - DNA, 22 bp, Homo sapiens
gccaggtgcatattagaagcat

SEQ ID NO: 10063818 - DNA, 22 bp, Homo sapiens
gccaggctggcaaaaggaaacc

SEQ ID NO: 10063819 - DNA, 22 bp, Homo sapiens
gcaggcctttatccctgcctca

SEQ ID NO: 10063820 - DNA, 22 bp, Homo sapiens
gcagctgcctattcagggcttg

SEQ ID NO: 10063821 - DNA, 22 bp, Homo sapiens
gcatcagaatcatccggggaat

SEQ ID NO: 10063822 - DNA, 21 bp, Homo sapiens
gcagtgcttcgagactgtggt

SEQ ID NO: 10063823 - DNA, 22 bp, Homo sapiens
gcaccttggctttcttggtggc

SEQ ID NO: 10063824 - DNA, 22 bp, Homo sapiens
attagaaaaactcaagggctct

SEQ ID NO: 10063825 - DNA, 22 bp, Homo sapiens
atggtcttgattttccataggt

SEQ ID NO: 10063826 - DNA, 22 bp, Homo sapiens
atggtcttctcaagcaacactg

SEQ ID NO: 10063827 - DNA, 22 bp, Homo sapiens
atggtcttagggtaggcagctg

SEQ ID NO: 10063828 - DNA, 22 bp, Homo sapiens
atgggaaagaagccactgccca

SEQ ID NO: 10063829 - DNA, 22 bp, Homo sapiens
atgggaatataattttagcaac

SEQ ID NO: 10063830 - DNA, 23 bp, Homo sapiens
gagagcaatgagatgtaaacact

SEQ ID NO: 10063831 - DNA, 22 bp, Homo sapiens
gagagcaatggggacgggcagg

SEQ ID NO: 10063832 - DNA, 22 bp, Homo sapiens
gagagcagactctcaaagctgg

SEQ ID NO: 10063833 - DNA, 23 bp, Homo sapiens
gagagagattgctaaaccactcc

SEQ ID NO: 10063834 - DNA, 22 bp, Homo sapiens
gagagagaggtgctgccaggca

SEQ ID NO: 10063835 - DNA, 22 bp, Homo sapiens
gagagagagctaatattaagct

SEQ ID NO: 10063836 - DNA, 22 bp, Homo sapiens
gagagagaaggcctgtgggtgt

SEQ ID NO: 10063837 - DNA, 22 bp, Homo sapiens
gagagagaagtgggtgtcacct

SEQ ID NO: 10063838 - DNA, 22 bp, Homo sapiens
gagagagacatgtaaacgcggt

SEQ ID NO: 10063839 - DNA, 22 bp, Homo sapiens
gactggggctctagccaggcct

SEQ ID NO: 10063840 - DNA, 22 bp, Homo sapiens
atgtcccttgtctgtgatgtct

SEQ ID NO: 10063841 - DNA, 22 bp, Homo sapiens
atgtcccttctttggtgctcag

SEQ ID NO: 10063842 - DNA, 22 bp, Homo sapiens
gagggctctgaaaggaggtcac

SEQ ID NO: 10063843 - DNA, 22 bp, Homo sapiens
gagggctctgtctggaagggaa

SEQ ID NO: 10063844 - DNA, 19 bp, Homo sapiens
gagggctcatttgaacaat

SEQ ID NO: 10063845 - DNA, 22 bp, Homo sapiens
atgttctgaatcaagcaactct

SEQ ID NO: 10063846 - DNA, 21 bp, Homo sapiens
gacacaaagggtagtaatggt

SEQ ID NO: 10063847 - DNA, 22 bp, Homo sapiens
gaccttgtgatccagccacctt

SEQ ID NO: 10063848 - DNA, 22 bp, Homo sapiens
gaccttgtgctccgaggcgggc

SEQ ID NO: 10063849 - DNA, 22 bp, Homo sapiens
gaccttgtgatccacccgcttt

SEQ ID NO: 10063850 - DNA, 22 bp, Homo sapiens
gaacaaagacatggaggaggat

SEQ ID NO: 10063851 - DNA, 22 bp, Homo sapiens
atgcacagatcctggcacttag

SEQ ID NO: 10063852 - DNA, 22 bp, Homo sapiens
cttcttgtcagtgatttcttcc

SEQ ID NO: 10063853 - DNA, 22 bp, Homo sapiens
cttcttgtgcactctctatgta

SEQ ID NO: 10063854 - DNA, 22 bp, Homo sapiens
cttcttgtgctgggccagcttc

SEQ ID NO: 10063855 - DNA, 22 bp, Homo sapiens
cttcttgttttagccctcatac

SEQ ID NO: 10063856 - DNA, 19 bp, Homo sapiens
atgatctgcccttgtaata

SEQ ID NO: 10063857 - DNA, 22 bp, Homo sapiens
agcccttagtacatttctcaag

SEQ ID NO: 10063858 - DNA, 22 bp, Homo sapiens
agcctacagagggcaggtggag

SEQ ID NO: 10063859 - DNA, 22 bp, Homo sapiens
cagatcaaacaaaatgggttag

SEQ ID NO: 10063860 - DNA, 22 bp, Homo sapiens
agccctcctggggccacgctgg

SEQ ID NO: 10063861 - DNA, 17 bp, Homo sapiens
cagaggagctttggggg

SEQ ID NO: 10063862 - DNA, 18 bp, Homo sapiens
cagagcagtatgaatgtt

SEQ ID NO: 10063863 - DNA, 22 bp, Homo sapiens
cagagcaggtatctttggtgaa

SEQ ID NO: 10063864 - DNA, 22 bp, Homo sapiens
cagagcagtaaatctggggcac

SEQ ID NO: 10063865 - DNA, 22 bp, Homo sapiens
cagagcagtaaatctggggcac

SEQ ID NO: 10063866 - DNA, 22 bp, Homo sapiens
cagagcagggtgcaccttgggc

SEQ ID NO: 10063867 - DNA, 22 bp, Homo sapiens
agccaggctcaaggcctgctcc

SEQ ID NO: 10063868 - DNA, 22 bp, Homo sapiens
agccaagcactcaactcctgga

SEQ ID NO: 10063869 - DNA, 22 bp, Homo sapiens
cagcccaggtctctcttccagt

SEQ ID NO: 10063870 - DNA, 22 bp, Homo sapiens
cagcccaggtggcggaggttgc

SEQ ID NO: 10063871 - DNA, 22 bp, Homo sapiens
cagcccagtgcatttgtgtact

SEQ ID NO: 10063872 - DNA, 22 bp, Homo sapiens
cagcccagtgcacgcccgtttc

SEQ ID NO: 10063873 - DNA, 22 bp, Homo sapiens
cagcccagtaccaagcagttgg

SEQ ID NO: 10063874 - DNA, 22 bp, Homo sapiens
cagcctcctgggacactcaccg

SEQ ID NO: 10063875 - DNA, 22 bp, Homo sapiens
cagcctcctgggacactcaccg

SEQ ID NO: 10063876 - DNA, 22 bp, Homo sapiens
cagcccagagatgttatctagt

SEQ ID NO: 10063877 - DNA, 16 bp, Homo sapiens
cagcccaggggcgggc

SEQ ID NO: 10063878 - DNA, 21 bp, Homo sapiens
cagcccagagcagtggggcca

SEQ ID NO: 10063879 - DNA, 19 bp, Homo sapiens
cagcccagggtgctaccaa

SEQ ID NO: 10063880 - DNA, 22 bp, Homo sapiens
cagcccagacaccatcattcta

SEQ ID NO: 10063881 - DNA, 22 bp, Homo sapiens
cagcccagagaaggggcccgtg

SEQ ID NO: 10063882 - DNA, 22 bp, Homo sapiens
cagcccagaactcacgtctcca

SEQ ID NO: 10063883 - DNA, 22 bp, Homo sapiens
cagctggcaagtggagcagggt

SEQ ID NO: 10063884 - DNA, 22 bp, Homo sapiens
cagcgaggtgaagggtacaagc

SEQ ID NO: 10063885 - DNA, 22 bp, Homo sapiens
caagcttgtttctcctgggggt

SEQ ID NO: 10063886 - DNA, 22 bp, Homo sapiens
caaggcattgtgtaagcacttg

SEQ ID NO: 10063887 - DNA, 22 bp, Homo sapiens
caaggcattctcaccaactctc

SEQ ID NO: 10063888 - DNA, 22 bp, Homo sapiens
caagggctcttttgaggaatgt

SEQ ID NO: 10063889 - DNA, 22 bp, Homo sapiens
caagggctgaacacaggtttca

SEQ ID NO: 10063890 - DNA, 22 bp, Homo sapiens
cacaggctccggccttgcagcc

SEQ ID NO: 10063891 - DNA, 19 bp, Homo sapiens
agcaggctaggctgcctct

SEQ ID NO: 10063892 - DNA, 22 bp, Homo sapiens
agcaggctaggaacctcactgc

SEQ ID NO: 10063893 - DNA, 22 bp, Homo sapiens
cacaggctgcccgcagctggga

SEQ ID NO: 10063894 - DNA, 22 bp, Homo sapiens
agcaggtggcctcctgtctgtc

SEQ ID NO: 10063895 - DNA, 22 bp, Homo sapiens
atgaccagactctcagtggggt

SEQ ID NO: 10063896 - DNA, 22 bp, Homo sapiens
atgattgaaaatgacattgcca

SEQ ID NO: 10063897 - DNA, 16 bp, Homo sapiens
atgggcagtgaggaag

SEQ ID NO: 10063898 - DNA, 22 bp, Homo sapiens
agagctccgtgcctggctgcca

SEQ ID NO: 10063899 - DNA, 22 bp, Homo sapiens
agagctccaagaagtcctgcag

SEQ ID NO: 10063900 - DNA, 22 bp, Homo sapiens
attaagtgtcaggcagggagtg

SEQ ID NO: 10063901 - DNA, 22 bp, Homo sapiens
attaagtgactaaagtaatgct

SEQ ID NO: 10063902 - DNA, 22 bp, Homo sapiens
attaagtgtattgctgagggta

SEQ ID NO: 10063903 - DNA, 22 bp, Homo sapiens
agagccagcatttgggccctgc

SEQ ID NO: 10063904 - DNA, 22 bp, Homo sapiens
agagccaggaagtggcgtgggg

SEQ ID NO: 10063905 - DNA, 22 bp, Homo sapiens
agagccagccttctcagcttac

SEQ ID NO: 10063906 - DNA, 22 bp, Homo sapiens
agagccagcatttgacactggc

SEQ ID NO: 10063907 - DNA, 22 bp, Homo sapiens
agagccaggactgtgtctcact

SEQ ID NO: 10063908 - DNA, 22 bp, Homo sapiens
agagccaggatgtcttctgggg

SEQ ID NO: 10063909 - DNA, 22 bp, Homo sapiens
agattgggattagagatctgta

SEQ ID NO: 10063910 - DNA, 22 bp, Homo sapiens
agatgatgaccatgggaatgga

SEQ ID NO: 10063911 - DNA, 17 bp, Homo sapiens
aggcacctcttcctgct

SEQ ID NO: 10063912 - DNA, 21 bp, Homo sapiens
aggaggccagtactgctgaac

SEQ ID NO: 10063913 - DNA, 22 bp, Homo sapiens
aggaggccattctctcagtagc

SEQ ID NO: 10063914 - DNA, 22 bp, Homo sapiens
acagggcagtgtcttgaaaaat

SEQ ID NO: 10063915 - DNA, 21 bp, Homo sapiens
acagggcatgcagctggctgt

SEQ ID NO: 10063916 - DNA, 21 bp, Homo sapiens
acagggcatgcagctggctgt

SEQ ID NO: 10063917 - DNA, 22 bp, Homo sapiens
acagggcatgtgcaagagacat

SEQ ID NO: 10063918 - DNA, 22 bp, Homo sapiens
acagggcatttcctctatgtgt

SEQ ID NO: 10063919 - DNA, 23 bp, Homo sapiens
acagggcattgctggcctcgagg

SEQ ID NO: 10063920 - DNA, 22 bp, Homo sapiens
acagggcaggtggctactggtc

SEQ ID NO: 10063921 - DNA, 21 bp, Homo sapiens
acaggctctggggatgctggg

SEQ ID NO: 10063922 - DNA, 22 bp, Homo sapiens
acaggctcagttcactggattt

SEQ ID NO: 10063923 - DNA, 21 bp, Homo sapiens
acaggctcacgatccatttct

SEQ ID NO: 10063924 - DNA, 22 bp, Homo sapiens
acaggctctcagccagttggca

SEQ ID NO: 10063925 - DNA, 22 bp, Homo sapiens
acaggctcgtgcgcgcacgtgt

SEQ ID NO: 10063926 - DNA, 22 bp, Homo sapiens
acaggctctctattgagtgcag

SEQ ID NO: 10063927 - DNA, 22 bp, Homo sapiens
acaggctcacagtcatttcatt

SEQ ID NO: 10063928 - DNA, 22 bp, Homo sapiens
aggacagtggcagggtgacaga

SEQ ID NO: 10063929 - DNA, 22 bp, Homo sapiens
aggacagtggcagggtgacaga

SEQ ID NO: 10063930 - DNA, 22 bp, Homo sapiens
aggacagtggtgttctggagtg

SEQ ID NO: 10063931 - DNA, 22 bp, Homo sapiens
aggacagttaaaaatagatggc

SEQ ID NO: 10063932 - DNA, 22 bp, Homo sapiens
aggacagtgtggaagagggtgc

SEQ ID NO: 10063933 - DNA, 20 bp, Homo sapiens
acagccagaggaggcagaca

SEQ ID NO: 10063934 - DNA, 22 bp, Homo sapiens
aggctgggaaatgtagtcttcc

SEQ ID NO: 10063935 - DNA, 22 bp, Homo sapiens
aggctgggaaatgtattccagc

SEQ ID NO: 10063936 - DNA, 22 bp, Homo sapiens
aggctctctctgccagccgtgc

SEQ ID NO: 10063937 - DNA, 22 bp, Homo sapiens
aggctctcctccccaggaccat

SEQ ID NO: 10063938 - DNA, 22 bp, Homo sapiens
aggctctcactatcctcctagc

SEQ ID NO: 10063939 - DNA, 22 bp, Homo sapiens
aggctctcaatatgatccagtc

SEQ ID NO: 10063940 - DNA, 22 bp, Homo sapiens
aggctctcaccctctgaccaga

SEQ ID NO: 10063941 - DNA, 22 bp, Homo sapiens
aggctcaggtctcaggtctggc

SEQ ID NO: 10063942 - DNA, 20 bp, Homo sapiens
aggctcagggtgtttaggaa

SEQ ID NO: 10063943 - DNA, 22 bp, Homo sapiens
aggcagtgtgtagctggaagag

SEQ ID NO: 10063944 - DNA, 22 bp, Homo sapiens
aggctcagggacggggcccctt

SEQ ID NO: 10063945 - DNA, 22 bp, Homo sapiens
aggctcagggactccctccctc

SEQ ID NO: 10063946 - DNA, 22 bp, Homo sapiens
aggctcaggcaggaatggcgga

SEQ ID NO: 10063947 - DNA, 22 bp, Homo sapiens
aggctcaggaggagctgccgga

SEQ ID NO: 10063948 - DNA, 22 bp, Homo sapiens
aggctcagacaggaaaagtaac

SEQ ID NO: 10063949 - DNA, 20 bp, Homo sapiens
aggctcagctgagctcttgg

SEQ ID NO: 10063950 - DNA, 22 bp, Homo sapiens
aggctcagctggtggtgatcgc

SEQ ID NO: 10063951 - DNA, 22 bp, Homo sapiens
agggccagcactcctggcagga

SEQ ID NO: 10063952 - DNA, 22 bp, Homo sapiens
agggccagtaccaggtgggtgg

SEQ ID NO: 10063953 - DNA, 22 bp, Homo sapiens
agggccagttcagaggacatgg

SEQ ID NO: 10063954 - DNA, 22 bp, Homo sapiens
agggctcaccactgtgcactcc

SEQ ID NO: 10063955 - DNA, 22 bp, Homo sapiens
agggctcaatggtgggcatgta

SEQ ID NO: 10063956 - DNA, 19 bp, Homo sapiens
agggcacagggacagaagg

SEQ ID NO: 10063957 - DNA, 22 bp, Homo sapiens
agggcaagttgagtgtgcgtgg

SEQ ID NO: 10063958 - DNA, 22 bp, Homo sapiens
accagacactgtgaagacaggc

SEQ ID NO: 10063959 - DNA, 22 bp, Homo sapiens
aggggcctcctcattggagtgt

SEQ ID NO: 10063960 - DNA, 22 bp, Homo sapiens
aggggttggacataagacagaa

SEQ ID NO: 10063961 - DNA, 22 bp, Homo sapiens
acctcccagaaagttttgcagg

SEQ ID NO: 10063962 - DNA, 22 bp, Homo sapiens
acctcccagctctgagcttggg

SEQ ID NO: 10063963 - DNA, 22 bp, Homo sapiens
aggggagcgacattccgtgccg

SEQ ID NO: 10063964 - DNA, 22 bp, Homo sapiens
aggggagctaacaccagagccc

SEQ ID NO: 10063965 - DNA, 22 bp, Homo sapiens
aggggagcttgaggcatggcct

SEQ ID NO: 10063966 - DNA, 22 bp, Homo sapiens
aggggagcttgcctggtcaccc

SEQ ID NO: 10063967 - DNA, 22 bp, Homo sapiens
aggggagcaaggccgtggtgta

SEQ ID NO: 10063968 - DNA, 22 bp, Homo sapiens
aggggagcatctgtgatggtta

SEQ ID NO: 10063969 - DNA, 22 bp, Homo sapiens
aggggagcaacatagtcactct

SEQ ID NO: 10063970 - DNA, 22 bp, Homo sapiens
aggggagccgaggggcatctgt

SEQ ID NO: 10063971 - DNA, 22 bp, Homo sapiens
aggggagcccctggtcctggtg

SEQ ID NO: 10063972 - DNA, 22 bp, Homo sapiens
aggggagccagggctgcgagtt

SEQ ID NO: 10063973 - DNA, 22 bp, Homo sapiens
agggctcagaacaatgagtgta

SEQ ID NO: 10063974 - DNA, 22 bp, Homo sapiens
aggtggagacccagagaaggcg

SEQ ID NO: 10063975 - DNA, 22 bp, Homo sapiens
agggtcccgtccctctgcaccc

SEQ ID NO: 10063976 - DNA, 22 bp, Homo sapiens
actcagaggcagctgctcaccc

SEQ ID NO: 10063977 - DNA, 22 bp, Homo sapiens
actcagaggaaaccctcctagg

SEQ ID NO: 10063978 - DNA, 22 bp, Homo sapiens
agtccaggcctccctctcctgc

SEQ ID NO: 10063979 - DNA, 22 bp, Homo sapiens
agtccaggcattccagccattc

SEQ ID NO: 10063980 - DNA, 21 bp, Homo sapiens
agtccaggagtcacccaagcc

SEQ ID NO: 10063981 - DNA, 22 bp, Homo sapiens
agtggcagagccaagatatgat

SEQ ID NO: 10063982 - DNA, 22 bp, Homo sapiens
agtggcagacagagacagtacc

SEQ ID NO: 10063983 - DNA, 22 bp, Homo sapiens
agtgctgttggataatgctgtc

SEQ ID NO: 10063984 - DNA, 22 bp, Homo sapiens
agtgctgtctccttcccccggg

SEQ ID NO: 10063985 - DNA, 22 bp, Homo sapiens
agtgcaaagggatcagattggg

SEQ ID NO: 10063986 - DNA, 22 bp, Homo sapiens
agtgcaaattatttacctgatt

SEQ ID NO: 10063987 - DNA, 22 bp, Homo sapiens
agtgcaaagggctgttgagaag

SEQ ID NO: 10063988 - DNA, 22 bp, Homo sapiens
agtgcaaagcagcctgtacacc

SEQ ID NO: 10063989 - DNA, 22 bp, Homo sapiens
agtgcaaagctgctgctgtggt

SEQ ID NO: 10063990 - DNA, 22 bp, Homo sapiens
agtgcaaaaaagtgttgtgaca

SEQ ID NO: 10063991 - DNA, 22 bp, Homo sapiens
agtgcaaactttattgtgacct

SEQ ID NO: 10063992 - DNA, 22 bp, Homo sapiens
agtgagagtattaatgtgaact

SEQ ID NO: 10063993 - DNA, 22 bp, Homo sapiens
agtgagcatcttcaggagccaa

SEQ ID NO: 10063994 - DNA, 22 bp, Homo sapiens
agtgagcatccagagaggtggg

SEQ ID NO: 10063995 - DNA, 21 bp, Homo sapiens
agtgagcatccagagaggtgg

SEQ ID NO: 10063996 - DNA, 19 bp, Homo sapiens
agtgagcatccagagaggt

SEQ ID NO: 10063997 - DNA, 22 bp, Homo sapiens
agtgagcactgttgttggttcc

SEQ ID NO: 10063998 - DNA, 23 bp, Homo sapiens
agtgagcagctgtagggcaagga

SEQ ID NO: 10063999 - DNA, 22 bp, Homo sapiens
agtgagcaacagaagcgtgggt

SEQ ID NO: 10064000 - DNA, 19 bp, Homo sapiens
agtgagcatggcttgactg

SEQ ID NO: 10064001 - DNA, 22 bp, Homo sapiens
agtgagcattcgtttggaaccc

SEQ ID NO: 10064002 - DNA, 22 bp, Homo sapiens
actggggtgaaattggagtgtc

SEQ ID NO: 10064003 - DNA, 20 bp, Homo sapiens
agtgtggttttcaggaatat

SEQ ID NO: 10064004 - DNA, 22 bp, Homo sapiens
agaagccatggtatgcaactac

SEQ ID NO: 10064005 - DNA, 22 bp, Homo sapiens
atcctgggaatgggagggtcat

SEQ ID NO: 10064006 - DNA, 22 bp, Homo sapiens
agaagccattgaagcagacctc

SEQ ID NO: 10064007 - DNA, 22 bp, Homo sapiens
agaagcagctttcaaggtgatt

SEQ ID NO: 10064008 - DNA, 19 bp, Homo sapiens
agaagcaccagtcattcct

SEQ ID NO: 10064009 - DNA, 22 bp, Homo sapiens
atcaagcacttctacatgacat

SEQ ID NO: 10064010 - DNA, 22 bp, Homo sapiens
agttcacagaatggccagaact

SEQ ID NO: 10064011 - DNA, 22 bp, Homo sapiens
agttcacaatagaagaggtggc

SEQ ID NO: 10064012 - DNA, 17 bp, Homo sapiens
agaaaagagaccagcag

SEQ ID NO: 10064013 - DNA, 22 bp, Homo sapiens
aagcccagtttcacactgagac

SEQ ID NO: 10064014 - DNA, 19 bp, Homo sapiens
aagcccagtgtatgctctt

SEQ ID NO: 10064015 - DNA, 22 bp, Homo sapiens
aagcccagtaccttcagtgagg

SEQ ID NO: 10064016 - DNA, 22 bp, Homo sapiens
aagcccagctgaaagcattttt

SEQ ID NO: 10064017 - DNA, 22 bp, Homo sapiens
aagcccagggaatggtcgggag

SEQ ID NO: 10064018 - DNA, 22 bp, Homo sapiens
aagcccaggtaagtggctcatg

SEQ ID NO: 10064019 - DNA, 22 bp, Homo sapiens
aagcccagctgaaagcattttt

SEQ ID NO: 10064020 - DNA, 22 bp, Homo sapiens
aagcccagctctgcctgctctg

SEQ ID NO: 10064021 - DNA, 22 bp, Homo sapiens
acagccaggagccatgggcagg

SEQ ID NO: 10064022 - DNA, 22 bp, Homo sapiens
aagcccagcatccctgcaccag

SEQ ID NO: 10064023 - DNA, 22 bp, Homo sapiens
acagccaggcccagcacgcagg

SEQ ID NO: 10064024 - DNA, 22 bp, Homo sapiens
acagagcaattcttgggtgttt

SEQ ID NO: 10064025 - DNA, 22 bp, Homo sapiens
acagagcacagtcgggatggga

SEQ ID NO: 10064026 - DNA, 22 bp, Homo sapiens
acagagcaataacagggagagg

SEQ ID NO: 10064027 - DNA, 22 bp, Homo sapiens
acagagcaactttatttcatgg

SEQ ID NO: 10064028 - DNA, 18 bp, Homo sapiens
acacttcctggtggtgtg

SEQ ID NO: 10064029 - DNA, 22 bp, Homo sapiens
aatgcacttagtatgaatgcct

SEQ ID NO: 10064030 - DNA, 22 bp, Homo sapiens
aacagtgatatcaagacagaca

SEQ ID NO: 10064031 - DNA, 22 bp, Homo sapiens
aagtgcattagatagaatgatg

SEQ ID NO: 10064032 - DNA, 22 bp, Homo sapiens
aaggcactgactgtgcagggga

SEQ ID NO: 10064033 - DNA, 22 bp, Homo sapiens
aaggcactagcagaattagtga

SEQ ID NO: 10064034 - DNA, 22 bp, Homo sapiens
aaggcactcagccttgggacag

SEQ ID NO: 10064035 - DNA, 23 bp, Homo sapiens
aaggccagagagaggctagtgtc

SEQ ID NO: 10064036 - DNA, 22 bp, Homo sapiens
aaggctgagacagcacaggtcc

SEQ ID NO: 10064037 - DNA, 22 bp, Homo sapiens
aagagagaactcccttcgccag

SEQ ID NO: 10064038 - DNA, 22 bp, Homo sapiens
aagagagacaataggtagcatt

SEQ ID NO: 10064039 - DNA, 22 bp, Homo sapiens
aagagagaagtctctctggttc

SEQ ID NO: 10064040 - DNA, 22 bp, Homo sapiens
aagagagagtgcgctcacagaa

SEQ ID NO: 10064041 - DNA, 22 bp, Homo sapiens
aagagagaccatgggggacagg

SEQ ID NO: 10064042 - DNA, 22 bp, Homo sapiens
aagagagagcattcttctgtta

SEQ ID NO: 10064043 - DNA, 22 bp, Homo sapiens
aaatgatgattaaaatgaggta

SEQ ID NO: 10064044 - DNA, 22 bp, Homo sapiens
aaatgatgctcacagattagtg

SEQ ID NO: 10064045 - DNA, 22 bp, Homo sapiens
aaatgatgttataagaccagga

SEQ ID NO: 10064046 - DNA, 22 bp, Homo sapiens
aaaggctgaaggagttgtcata

SEQ ID NO: 10064047 - DNA, 22 bp, Homo sapiens
aaaggctgacagggtcctaagt

SEQ ID NO: 10064048 - DNA, 22 bp, Homo sapiens
aaaggcacacactccttgttat

SEQ ID NO: 10064049 - DNA, 22 bp, Homo sapiens
aaaggcactgatcttatccagt

SEQ ID NO: 10064050 - DNA, 22 bp, Homo sapiens
aaagcatttcatgtctagaaag

SEQ ID NO: 10064051 - DNA, 22 bp, Homo sapiens
aaagcatggttaaagacagtgg

SEQ ID NO: 10064052 - DNA, 22 bp, Homo sapiens
aaatgaactcttcctgcatccc

SEQ ID NO: 10064053 - DNA, 22 bp, Homo sapiens
aaaatgatatcctgacttttat

SEQ ID NO: 10064054 - DNA, 22 bp, Homo sapiens
aaagcaggcagcaggctggatt

SEQ ID NO: 10064055 - DNA, 22 bp, Homo sapiens
aagggaggtaaagctatttaaa

SEQ ID NO: 10064056 - DNA, 20 bp, Homo sapiens
aaggtaagaaagccctgccc

SEQ ID NO: 10064057 - DNA, 22 bp, Homo sapiens
acctctgccactttctaactct

SEQ ID NO: 10064058 - DNA, 22 bp, Homo sapiens
acccagggccacagcccgcagt

SEQ ID NO: 10064059 - DNA, 22 bp, Homo sapiens
acccaggggcagccttgctgtg

SEQ ID NO: 10064060 - DNA, 22 bp, Homo sapiens
acccaggggcgaagctggccac

SEQ ID NO: 10064061 - DNA, 22 bp, Homo sapiens
acagctggaggtctgtgagcac

SEQ ID NO: 10064062 - DNA, 22 bp, Homo sapiens
acagctggagtgaggatggagt

SEQ ID NO: 10064063 - DNA, 22 bp, Homo sapiens
aaggcaaaagaggtgtcatcac

SEQ ID NO: 10064064 - DNA, 22 bp, Homo sapiens
acatgacagtgcttagcaaact

SEQ ID NO: 10064065 - DNA, 22 bp, Homo sapiens
acatgcatggagggaaaatgtc

SEQ ID NO: 10064066 - DNA, 22 bp, Homo sapiens
aaggcacagaggcagggcactt

SEQ ID NO: 10064067 - DNA, 22 bp, Homo sapiens
aaggcacagccacttgatcatc

SEQ ID NO: 10064068 - DNA, 22 bp, Homo sapiens
aaggccagagcgtgtcctgcct

SEQ ID NO: 10064069 - DNA, 22 bp, Homo sapiens
aaggcatggcagggtttacaca

SEQ ID NO: 10064070 - DNA, 22 bp, Homo sapiens
aaggcattcaagatggaagttg

SEQ ID NO: 10064071 - DNA, 22 bp, Homo sapiens
aaggccagcctgagagctaaca

SEQ ID NO: 10064072 - DNA, 22 bp, Homo sapiens
actgtcctagaacctgcagctc

SEQ ID NO: 10064073 - DNA, 22 bp, Homo sapiens
agaagccagcttcagctgcccg

SEQ ID NO: 10064074 - DNA, 21 bp, Homo sapiens
aatcaagagtactggtgtggc

SEQ ID NO: 10064075 - DNA, 22 bp, Homo sapiens
agcggctgctccgcaggctggc

SEQ ID NO: 10064076 - DNA, 20 bp, Homo sapiens
agcggctggcggaggacacg

SEQ ID NO: 10064077 - DNA, 22 bp, Homo sapiens
agcggctgtcggccagccggag

SEQ ID NO: 10064078 - DNA, 22 bp, Homo sapiens
acagagggtctgggcacaggac

SEQ ID NO: 10064079 - DNA, 22 bp, Homo sapiens
acagaggtcacctttgtatctt

SEQ ID NO: 10064080 - DNA, 21 bp, Homo sapiens
agctgaggtaaggcaagagag

SEQ ID NO: 10064081 - DNA, 22 bp, Homo sapiens
agctgaggttgaagagtgaacg

SEQ ID NO: 10064082 - DNA, 22 bp, Homo sapiens
acagcagaccccagtgccatgg

SEQ ID NO: 10064083 - DNA, 22 bp, Homo sapiens
acagcagcatcctatttcactc

SEQ ID NO: 10064084 - DNA, 22 bp, Homo sapiens
acagcagcagaccagcatatgt

SEQ ID NO: 10064085 - DNA, 22 bp, Homo sapiens
acagcagatctgtggagcttat

SEQ ID NO: 10064086 - DNA, 21 bp, Homo sapiens
acagcagcaatctgtctttcc

SEQ ID NO: 10064087 - DNA, 22 bp, Homo sapiens
acaccagggatatgaggaagga

SEQ ID NO: 10064088 - DNA, 22 bp, Homo sapiens
acaccaggtcccgtctgtacct

SEQ ID NO: 10064089 - DNA, 22 bp, Homo sapiens
agcagggactgagccagtggga

SEQ ID NO: 10064090 - DNA, 22 bp, Homo sapiens
agatgctgctccacaggccagg

SEQ ID NO: 10064091 - DNA, 22 bp, Homo sapiens
agatgctgcagcctggactgga

SEQ ID NO: 10064092 - DNA, 22 bp, Homo sapiens
agatgctgcctctcctcacaag

SEQ ID NO: 10064093 - DNA, 22 bp, Homo sapiens
agatgctgaagctgaggcaaca

SEQ ID NO: 10064094 - DNA, 21 bp, Homo sapiens
agatgctgatgctgcaggtcc

SEQ ID NO: 10064095 - DNA, 21 bp, Homo sapiens
agcacacttacctgttctaag

SEQ ID NO: 10064096 - DNA, 22 bp, Homo sapiens
agcacaggctttggtgtgaggg

SEQ ID NO: 10064097 - DNA, 22 bp, Homo sapiens
agcacaggacgtagagcttgga

SEQ ID NO: 10064098 - DNA, 22 bp, Homo sapiens
agacagggtgatcgcttgagcc

SEQ ID NO: 10064099 - DNA, 22 bp, Homo sapiens
agagaagggggaaagatctcac

SEQ ID NO: 10064100 - DNA, 22 bp, Homo sapiens
tacaggcatgtagcatggtgat

SEQ ID NO: 10064101 - DNA, 22 bp, Homo sapiens
taagtgagccctcagagtatgg

SEQ ID NO: 10064102 - DNA, 21 bp, Homo sapiens
taagtgcaaagagacagatac

SEQ ID NO: 10064103 - DNA, 22 bp, Homo sapiens
taagtgagttcttgctagattt

SEQ ID NO: 10064104 - DNA, 22 bp, Homo sapiens
taaggtaattgttgctgaaatt

SEQ ID NO: 10064105 - DNA, 22 bp, Homo sapiens
gttcagagtgggaatgatcact

SEQ ID NO: 10064106 - DNA, 22 bp, Homo sapiens
gttggtccagcattgcctcact

SEQ ID NO: 10064107 - DNA, 22 bp, Homo sapiens
gttggtccaggagagtcacttc

SEQ ID NO: 10064108 - DNA, 22 bp, Homo sapiens
gttggtcctttgagcaagatcc

SEQ ID NO: 10064109 - DNA, 22 bp, Homo sapiens
tagaaaggcaatcattcttgga

SEQ ID NO: 10064110 - DNA, 22 bp, Homo sapiens
tagaaaagataacattctgtgc

SEQ ID NO: 10064111 - DNA, 22 bp, Homo sapiens
taggcactgtgtttgtaggagt

SEQ ID NO: 10064112 - DNA, 22 bp, Homo sapiens
taggctgggagcctgaggctag

SEQ ID NO: 10064113 - DNA, 22 bp, Homo sapiens
taggcactgggctaggacaggt

SEQ ID NO: 10064114 - DNA, 22 bp, Homo sapiens
taggcactgaggggagcaaggt

SEQ ID NO: 10064115 - DNA, 22 bp, Homo sapiens
taggcactggatgaccgaagag

SEQ ID NO: 10064116 - DNA, 22 bp, Homo sapiens
tagggcaatatttcccagaaaa

SEQ ID NO: 10064117 - DNA, 22 bp, Homo sapiens
tagggcaatatttcccagaaaa

SEQ ID NO: 10064118 - DNA, 22 bp, Homo sapiens
tagcccctgcctttgaacctgg

SEQ ID NO: 10064119 - DNA, 22 bp, Homo sapiens
tagcccagcatgagcagagctg

SEQ ID NO: 10064120 - DNA, 22 bp, Homo sapiens
tagcccaggagaattgtctttc

SEQ ID NO: 10064121 - DNA, 22 bp, Homo sapiens
tagcccaggctggagggcagtg

SEQ ID NO: 10064122 - DNA, 22 bp, Homo sapiens
tagcccagctaactcggtgagc

SEQ ID NO: 10064123 - DNA, 22 bp, Homo sapiens
tagcccagctcaaatgaccggt

SEQ ID NO: 10064124 - DNA, 22 bp, Homo sapiens
tagcccagcttggcctatttct

SEQ ID NO: 10064125 - DNA, 22 bp, Homo sapiens
tagcccaggctgtagtgcagtg

SEQ ID NO: 10064126 - DNA, 22 bp, Homo sapiens
tagcccaggctggagtgcaggg

SEQ ID NO: 10064127 - DNA, 22 bp, Homo sapiens
tagcagcccagtttctggccaa

SEQ ID NO: 10064128 - DNA, 22 bp, Homo sapiens
tagcagagtaatactttggagc

SEQ ID NO: 10064129 - DNA, 22 bp, Homo sapiens
tagcagagatatgggcatagat

SEQ ID NO: 10064130 - DNA, 22 bp, Homo sapiens
tattcttaattgctgagctgaa

SEQ ID NO: 10064131 - DNA, 22 bp, Homo sapiens
taggtgggtgacttccatgggg

SEQ ID NO: 10064132 - DNA, 18 bp, Homo sapiens
tccagagctactgtggtg

SEQ ID NO: 10064133 - DNA, 22 bp, Homo sapiens
tccagagcctgcgcactggctg

SEQ ID NO: 10064134 - DNA, 17 bp, Homo sapiens
tccagagcacagagctc

SEQ ID NO: 10064135 - DNA, 19 bp, Homo sapiens
tccagaactgccctggcct

SEQ ID NO: 10064136 - DNA, 22 bp, Homo sapiens
tccagagctctgggcatagctg

SEQ ID NO: 10064137 - DNA, 19 bp, Homo sapiens
tccaggctgagagtcagct

SEQ ID NO: 10064138 - DNA, 23 bp, Homo sapiens
tccaggctgaaggagcagatttt

SEQ ID NO: 10064139 - DNA, 22 bp, Homo sapiens
tccaggctctaggctgctctcc

SEQ ID NO: 10064140 - DNA, 22 bp, Homo sapiens
tccaggccacgacctcctggat

SEQ ID NO: 10064141 - DNA, 22 bp, Homo sapiens
tccagggccacagaggatgcta

SEQ ID NO: 10064142 - DNA, 20 bp, Homo sapiens
tccagggccctggctcctct

SEQ ID NO: 10064143 - DNA, 22 bp, Homo sapiens
tccagggcagggtgcgcatggg

SEQ ID NO: 10064144 - DNA, 20 bp, Homo sapiens
tccagggctagggagctcat

SEQ ID NO: 10064145 - DNA, 22 bp, Homo sapiens
tccagggcctgaggttgaagtg

SEQ ID NO: 10064146 - DNA, 22 bp, Homo sapiens
tccagggcgtgtgtgaaggaaa

SEQ ID NO: 10064147 - DNA, 22 bp, Homo sapiens
tccatcagcatgcaggctgttc

SEQ ID NO: 10064148 - DNA, 22 bp, Homo sapiens
tcccaagcttagggctctcagt

SEQ ID NO: 10064149 - DNA, 21 bp, Homo sapiens
tcccaagctgctggctcagct

SEQ ID NO: 10064150 - DNA, 22 bp, Homo sapiens
tcccaaggtgctcggcaacagg

SEQ ID NO: 10064151 - DNA, 22 bp, Homo sapiens
tcccacagatgctgtccagagt

SEQ ID NO: 10064152 - DNA, 22 bp, Homo sapiens
tccatgacagcgtgagagtttg

SEQ ID NO: 10064153 - DNA, 22 bp, Homo sapiens
tccatgactaggaaaccagttt

SEQ ID NO: 10064154 - DNA, 22 bp, Homo sapiens
tcccaggttccaccatccaggg

SEQ ID NO: 10064155 - DNA, 22 bp, Homo sapiens
tcccagggatcctccgggtcgc

SEQ ID NO: 10064156 - DNA, 22 bp, Homo sapiens
tcccagggttacagccagggca

SEQ ID NO: 10064157 - DNA, 22 bp, Homo sapiens
tccccacatctctgcatcaggc

SEQ ID NO: 10064158 - DNA, 22 bp, Homo sapiens
tccccaggggcctgggcacagt

SEQ ID NO: 10064159 - DNA, 22 bp, Homo sapiens
tcagcacaggtcttgcaaaaca

SEQ ID NO: 10064160 - DNA, 22 bp, Homo sapiens
tcagagccctgctcctccccaa

SEQ ID NO: 10064161 - DNA, 22 bp, Homo sapiens
tcagagcccctccgctgtccca

SEQ ID NO: 10064162 - DNA, 22 bp, Homo sapiens
tcagagcattagaggtttgtat

SEQ ID NO: 10064163 - DNA, 20 bp, Homo sapiens
tcagagcagttggcttgtct

SEQ ID NO: 10064164 - DNA, 22 bp, Homo sapiens
tcagagcagactttgaaggagg

SEQ ID NO: 10064165 - DNA, 22 bp, Homo sapiens
tcagagcacttggctcatggca

SEQ ID NO: 10064166 - DNA, 23 bp, Homo sapiens
tcagagaggccccctgcagagat

SEQ ID NO: 10064167 - DNA, 22 bp, Homo sapiens
tcagagaggcaatactgtttaa

SEQ ID NO: 10064168 - DNA, 22 bp, Homo sapiens
tcagagcacttggctcatggca

SEQ ID NO: 10064169 - DNA, 22 bp, Homo sapiens
tcagagaggttaaatatcttgt

SEQ ID NO: 10064170 - DNA, 22 bp, Homo sapiens
tcagagcaccacacagttccct

SEQ ID NO: 10064171 - DNA, 22 bp, Homo sapiens
tcagaaaaggtagctgtgacaa

SEQ ID NO: 10064172 - DNA, 22 bp, Homo sapiens
tcaccactgaggccacgtggct

SEQ ID NO: 10064173 - DNA, 22 bp, Homo sapiens
tcaccactcactcaggcaagtc

SEQ ID NO: 10064174 - DNA, 22 bp, Homo sapiens
tcacccaggctggagtgtagtg

SEQ ID NO: 10064175 - DNA, 22 bp, Homo sapiens
tcacagggtgtacatcacctat

SEQ ID NO: 10064176 - DNA, 22 bp, Homo sapiens
tcaagacagatgggtaacttgg

SEQ ID NO: 10064177 - DNA, 22 bp, Homo sapiens
tcaagacatcactgtgcatttt

SEQ ID NO: 10064178 - DNA, 22 bp, Homo sapiens
tcaaggccagggaatgtagggg

SEQ ID NO: 10064179 - DNA, 22 bp, Homo sapiens
tcagtgcaaaaaatgggctaga

SEQ ID NO: 10064180 - DNA, 22 bp, Homo sapiens
tcaggccagcaccatccctatc

SEQ ID NO: 10064181 - DNA, 22 bp, Homo sapiens
ggacacaggcagctgggtgggt

SEQ ID NO: 10064182 - DNA, 22 bp, Homo sapiens
ggacagggtaagtactagtgtg

SEQ ID NO: 10064183 - DNA, 22 bp, Homo sapiens
ggacatggaaatcggcttgctc

SEQ ID NO: 10064184 - DNA, 22 bp, Homo sapiens
ggacatcttggttgcttccaag

SEQ ID NO: 10064185 - DNA, 19 bp, Homo sapiens
ggaccaggtcctgggcagc

SEQ ID NO: 10064186 - DNA, 22 bp, Homo sapiens
ggagcatgtggggtgagcaggg

SEQ ID NO: 10064187 - DNA, 22 bp, Homo sapiens
ggagcagggaattacagcgcag

SEQ ID NO: 10064188 - DNA, 22 bp, Homo sapiens
ggagcaggcagggccgtgtctg

SEQ ID NO: 10064189 - DNA, 22 bp, Homo sapiens
ggagactctcattgtcaagctt

SEQ ID NO: 10064190 - DNA, 22 bp, Homo sapiens
ggagactcaccccgcattctag

SEQ ID NO: 10064191 - DNA, 22 bp, Homo sapiens
ggacacagataatcacacagat

SEQ ID NO: 10064192 - DNA, 22 bp, Homo sapiens
gctggctgccttactttgtgga

SEQ ID NO: 10064193 - DNA, 22 bp, Homo sapiens
gctggagaaactgcagctgagg

SEQ ID NO: 10064194 - DNA, 22 bp, Homo sapiens
gctgtggctgtacagagaccat

SEQ ID NO: 10064195 - DNA, 22 bp, Homo sapiens
gctgtggctgaccaccaggggg

SEQ ID NO: 10064196 - DNA, 22 bp, Homo sapiens
gctggggagggcgtcaaggcca

SEQ ID NO: 10064197 - DNA, 22 bp, Homo sapiens
gctgtgtgaaaactgggcctgg

SEQ ID NO: 10064198 - DNA, 22 bp, Homo sapiens
gcttcttgcctgtgtagagaat

SEQ ID NO: 10064199 - DNA, 19 bp, Homo sapiens
gcttgctggcgggggtctg

SEQ ID NO: 10064200 - DNA, 22 bp, Homo sapiens
gcttgctggtgcctgcaggctc

SEQ ID NO: 10064201 - DNA, 22 bp, Homo sapiens
gctcctctcccagagctgcagg

SEQ ID NO: 10064202 - DNA, 22 bp, Homo sapiens
gctccctgtgctctgagtgata

SEQ ID NO: 10064203 - DNA, 22 bp, Homo sapiens
gctccctgttctcagccatgat

SEQ ID NO: 10064204 - DNA, 22 bp, Homo sapiens
gctctgggctgccctctggaca

SEQ ID NO: 10064205 - DNA, 22 bp, Homo sapiens
gctgagagatcaaggcaggatt

SEQ ID NO: 10064206 - DNA, 22 bp, Homo sapiens
gctgcctcaggcacctcctggc

SEQ ID NO: 10064207 - DNA, 22 bp, Homo sapiens
gctgcccagtgtgctcatgcag

SEQ ID NO: 10064208 - DNA, 22 bp, Homo sapiens
gctcagagttaattggatgggt

SEQ ID NO: 10064209 - DNA, 22 bp, Homo sapiens
gctccaggataataaagttgtt

SEQ ID NO: 10064210 - DNA, 22 bp, Homo sapiens
gctcagagtggcctggctaggg

SEQ ID NO: 10064211 - DNA, 19 bp, Homo sapiens
gctcagagtccccctgcgg

SEQ ID NO: 10064212 - DNA, 19 bp, Homo sapiens
gctcagagggccctgtgct

SEQ ID NO: 10064213 - DNA, 22 bp, Homo sapiens
gctcagaggccactgttggaaa

SEQ ID NO: 10064214 - DNA, 22 bp, Homo sapiens
gctcccagaaccaaggctgggg

SEQ ID NO: 10064215 - DNA, 22 bp, Homo sapiens
gctcccaccttaaccttcacat

SEQ ID NO: 10064216 - DNA, 22 bp, Homo sapiens
gctccaggtgtcccaggtaaaa

SEQ ID NO: 10064217 - DNA, 20 bp, Homo sapiens
gctccaggtcagagaggacg

SEQ ID NO: 10064218 - DNA, 22 bp, Homo sapiens
gctccctggtagccatgctctc

SEQ ID NO: 10064219 - DNA, 22 bp, Homo sapiens
gctccctggtattgctgccact

SEQ ID NO: 10064220 - DNA, 22 bp, Homo sapiens
gctccctgcactctgcagccct

SEQ ID NO: 10064221 - DNA, 22 bp, Homo sapiens
gctccctgaagagatttggtct

SEQ ID NO: 10064222 - DNA, 22 bp, Homo sapiens
gctccctgcatttcccaccctt

SEQ ID NO: 10064223 - DNA, 22 bp, Homo sapiens
gctccctgcagctgagagttcc

SEQ ID NO: 10064224 - DNA, 22 bp, Homo sapiens
gccttgggattcttggatgctc

SEQ ID NO: 10064225 - DNA, 22 bp, Homo sapiens
gccttgggcacaggcagggccc

SEQ ID NO: 10064226 - DNA, 22 bp, Homo sapiens
gccttgggggtgaaagaggcta

SEQ ID NO: 10064227 - DNA, 18 bp, Homo sapiens
gcctttggactgctccca

SEQ ID NO: 10064228 - DNA, 22 bp, Homo sapiens
gcctttggtgacaggcatgtgt

SEQ ID NO: 10064229 - DNA, 22 bp, Homo sapiens
gcgtctcaaggcccccaggcca

SEQ ID NO: 10064230 - DNA, 22 bp, Homo sapiens
gcgtctcaaggcccccaggcca

SEQ ID NO: 10064231 - DNA, 22 bp, Homo sapiens
gcgtggggcagcccagggcttc

SEQ ID NO: 10064232 - DNA, 22 bp, Homo sapiens
gccaggcagccaccctctgcga

SEQ ID NO: 10064233 - DNA, 22 bp, Homo sapiens
gccagggcaggggagcatctgc

SEQ ID NO: 10064234 - DNA, 22 bp, Homo sapiens
gccaccccaacctccctaagtt

SEQ ID NO: 10064235 - DNA, 20 bp, Homo sapiens
gccaggcactgttctcaata

SEQ ID NO: 10064236 - DNA, 22 bp, Homo sapiens
gccaggcagagccccgtgcagc

SEQ ID NO: 10064237 - DNA, 22 bp, Homo sapiens
gcatggccttgtgctccttctc

SEQ ID NO: 10064238 - DNA, 22 bp, Homo sapiens
gcaggggagtccactctatgca

SEQ ID NO: 10064239 - DNA, 22 bp, Homo sapiens
gcaggggagtggatgatggatt

SEQ ID NO: 10064240 - DNA, 22 bp, Homo sapiens
gcagtgggaaggttggcacatg

SEQ ID NO: 10064241 - DNA, 22 bp, Homo sapiens
gccaggggacgcggagcgacga

SEQ ID NO: 10064242 - DNA, 22 bp, Homo sapiens
gcccaggagaggccagggctga

SEQ ID NO: 10064243 - DNA, 22 bp, Homo sapiens
gcccagctttttgaggcaggca

SEQ ID NO: 10064244 - DNA, 22 bp, Homo sapiens
gcctcctaccacaccctcagtc

SEQ ID NO: 10064245 - DNA, 22 bp, Homo sapiens
gcctcctcacaatgtacccacg

SEQ ID NO: 10064246 - DNA, 22 bp, Homo sapiens
gcctcctgagaagccacaggct

SEQ ID NO: 10064247 - DNA, 22 bp, Homo sapiens
gcagagcaccctgcagtggtat

SEQ ID NO: 10064248 - DNA, 22 bp, Homo sapiens
gcagagcaccaaagtgaaagat

SEQ ID NO: 10064249 - DNA, 19 bp, Homo sapiens
gcagacaggtccagagagg

SEQ ID NO: 10064250 - DNA, 22 bp, Homo sapiens
gcacatgagctgctgggatggg

SEQ ID NO: 10064251 - DNA, 22 bp, Homo sapiens
gcagaggcacagccccagatga

SEQ ID NO: 10064252 - DNA, 22 bp, Homo sapiens
gcagagcaggaaggaagtcagg

SEQ ID NO: 10064253 - DNA, 22 bp, Homo sapiens
gcagagcagcaaatggaaagga

SEQ ID NO: 10064254 - DNA, 22 bp, Homo sapiens
gcacaggctccggaggagagct

SEQ ID NO: 10064255 - DNA, 22 bp, Homo sapiens
gaggccaggaggatctctctaa

SEQ ID NO: 10064256 - DNA, 22 bp, Homo sapiens
gcagggacagggcagggccttt

SEQ ID NO: 10064257 - DNA, 22 bp, Homo sapiens
gcaggcagttatttagtagaat

SEQ ID NO: 10064258 - DNA, 23 bp, Homo sapiens
gcagatggccccagagtgctgcc

SEQ ID NO: 10064259 - DNA, 22 bp, Homo sapiens
gggagacaagaagtagcctgct

SEQ ID NO: 10064260 - DNA, 22 bp, Homo sapiens
gggagctgtaagggacaggtag

SEQ ID NO: 10064261 - DNA, 22 bp, Homo sapiens
gggagctgtcatcagtgttgtc

SEQ ID NO: 10064262 - DNA, 18 bp, Homo sapiens
gggagctgggaagctggt

SEQ ID NO: 10064263 - DNA, 22 bp, Homo sapiens
gggagctgggctggttttgctg

SEQ ID NO: 10064264 - DNA, 22 bp, Homo sapiens
gggagctggttcctgccctcca

SEQ ID NO: 10064265 - DNA, 22 bp, Homo sapiens
gggagctggcggattccccagg

SEQ ID NO: 10064266 - DNA, 22 bp, Homo sapiens
ggcttgggagcaggcatgtgac

SEQ ID NO: 10064267 - DNA, 22 bp, Homo sapiens
gggacaggcaaaggtatgcttc

SEQ ID NO: 10064268 - DNA, 22 bp, Homo sapiens
gggaccagaagaaggatggtga

SEQ ID NO: 10064269 - DNA, 23 bp, Homo sapiens
gggaccagctagggctgtgacct

SEQ ID NO: 10064270 - DNA, 19 bp, Homo sapiens
gggagctgtctgcccgtgg

SEQ ID NO: 10064271 - DNA, 22 bp, Homo sapiens
gggagctgtgggattggttgag

SEQ ID NO: 10064272 - DNA, 22 bp, Homo sapiens
gggaggaaggcttgggtgagta

SEQ ID NO: 10064273 - DNA, 22 bp, Homo sapiens
gggcacaggaatttgggatgtg

SEQ ID NO: 10064274 - DNA, 22 bp, Homo sapiens
gggcaggatgcagtttcagaga

SEQ ID NO: 10064275 - DNA, 22 bp, Homo sapiens
ggcttctcccttcttctgattg

SEQ ID NO: 10064276 - DNA, 22 bp, Homo sapiens
ggcttctctgtctagtttctac

SEQ ID NO: 10064277 - DNA, 18 bp, Homo sapiens
ggcttctctgtttatttc

SEQ ID NO: 10064278 - DNA, 22 bp, Homo sapiens
ggctgggcaggtctgcacaggg

SEQ ID NO: 10064279 - DNA, 22 bp, Homo sapiens
ggctgagactagagtgaggcat

SEQ ID NO: 10064280 - DNA, 22 bp, Homo sapiens
ggctgagacaacctgggaccca

SEQ ID NO: 10064281 - DNA, 22 bp, Homo sapiens
ggcctctggttcacagggagga

SEQ ID NO: 10064282 - DNA, 22 bp, Homo sapiens
ggccttgggatgtggctgcagc

SEQ ID NO: 10064283 - DNA, 22 bp, Homo sapiens
ggccttgggctggctgcagtat

SEQ ID NO: 10064284 - DNA, 22 bp, Homo sapiens
ggccttgggcgagtccctcagt

SEQ ID NO: 10064285 - DNA, 22 bp, Homo sapiens
ggccttgggcagacacgtcaca

SEQ ID NO: 10064286 - DNA, 19 bp, Homo sapiens
ggccttggggtcccaaagt

SEQ ID NO: 10064287 - DNA, 22 bp, Homo sapiens
ggccttggtaaattggcatttg

SEQ ID NO: 10064288 - DNA, 22 bp, Homo sapiens
ggccttggtaatgggggactgt

SEQ ID NO: 10064289 - DNA, 22 bp, Homo sapiens
ggccttgggtataggtgggtat

SEQ ID NO: 10064290 - DNA, 22 bp, Homo sapiens
ggccagggcctggggactgtcc

SEQ ID NO: 10064291 - DNA, 22 bp, Homo sapiens
ggcaggtggacgtgctaaagct

SEQ ID NO: 10064292 - DNA, 22 bp, Homo sapiens
ggcaggtgggaaccctccccac

SEQ ID NO: 10064293 - DNA, 22 bp, Homo sapiens
ggcagtgaacagaaatgcagaa

SEQ ID NO: 10064294 - DNA, 22 bp, Homo sapiens
ggcatggcctgtaagacggaga

SEQ ID NO: 10064295 - DNA, 20 bp, Homo sapiens
ggcagagggcctgggagaag

SEQ ID NO: 10064296 - DNA, 22 bp, Homo sapiens
ggcaggaggaagagttagcacc

SEQ ID NO: 10064297 - DNA, 22 bp, Homo sapiens
ggcagaggaagctggaagtggg

SEQ ID NO: 10064298 - DNA, 22 bp, Homo sapiens
ggcacaggaatctgtgaagtgc

SEQ ID NO: 10064299 - DNA, 22 bp, Homo sapiens
ggagccagaggctgctgctgtg

SEQ ID NO: 10064300 - DNA, 22 bp, Homo sapiens
ggagccagagtctgcagtgtaa

SEQ ID NO: 10064301 - DNA, 22 bp, Homo sapiens
ggagccagcagggtgacactga

SEQ ID NO: 10064302 - DNA, 22 bp, Homo sapiens
ggagtccaacgtgcagccagga

SEQ ID NO: 10064303 - DNA, 22 bp, Homo sapiens
ggcaaaggaaaacgtctcagct

SEQ ID NO: 10064304 - DNA, 19 bp, Homo sapiens
gggcttggggctgaagcct

SEQ ID NO: 10064305 - DNA, 22 bp, Homo sapiens
gggcttggccccagaagagcta

SEQ ID NO: 10064306 - DNA, 20 bp, Homo sapiens
gggcttggaggactcgaggg

SEQ ID NO: 10064307 - DNA, 20 bp, Homo sapiens
gggcttggaggactcgaggg

SEQ ID NO: 10064308 - DNA, 22 bp, Homo sapiens
gggtagggtgacttaggctggc

SEQ ID NO: 10064309 - DNA, 22 bp, Homo sapiens
ggggctcaggggaagtgtccag

SEQ ID NO: 10064310 - DNA, 22 bp, Homo sapiens
ggtcagagaaaagtagggtgtt

SEQ ID NO: 10064311 - DNA, 22 bp, Homo sapiens
ggtcagagctggagagataggg

SEQ ID NO: 10064312 - DNA, 22 bp, Homo sapiens
ggtcagaggaggaataggacat

SEQ ID NO: 10064313 - DNA, 22 bp, Homo sapiens
ggtctcctgacctttagtccct

SEQ ID NO: 10064314 - DNA, 22 bp, Homo sapiens
ggtctcctgaggctgccacacc

SEQ ID NO: 10064315 - DNA, 22 bp, Homo sapiens
ggtctccttgggaaagcaggaa

SEQ ID NO: 10064316 - DNA, 22 bp, Homo sapiens
ggtctcctgggttgaccagctg

SEQ ID NO: 10064317 - DNA, 22 bp, Homo sapiens
ggtgtgggggcagctctgatat

SEQ ID NO: 10064318 - DNA, 22 bp, Homo sapiens
ggtgtgggtcagctttattaat

SEQ ID NO: 10064319 - DNA, 22 bp, Homo sapiens
ggtgtggggaggttctgcttct

SEQ ID NO: 10064320 - DNA, 22 bp, Homo sapiens
ggtgtgggtccttgtgcttgct

SEQ ID NO: 10064321 - DNA, 22 bp, Homo sapiens
ggtgttgggctcactggtcctt

SEQ ID NO: 10064322 - DNA, 22 bp, Homo sapiens
ggtggctcacgcctgtaagccc

SEQ ID NO: 10064323 - DNA, 22 bp, Homo sapiens
ggtggccttttatgagcagggt

SEQ ID NO: 10064324 - DNA, 22 bp, Homo sapiens
ggtggctcagggctccaagcat

SEQ ID NO: 10064325 - DNA, 22 bp, Homo sapiens
ggtggctcagtgtcaggccctg

SEQ ID NO: 10064326 - DNA, 22 bp, Homo sapiens
ggtggctcccacccagctttga

SEQ ID NO: 10064327 - DNA, 22 bp, Homo sapiens
ggtggcctgccctgatccctgg

SEQ ID NO: 10064328 - DNA, 22 bp, Homo sapiens
ggtggcctccagggcataggtg

SEQ ID NO: 10064329 - DNA, 22 bp, Homo sapiens
ggtggcctagggcccagcctgt

SEQ ID NO: 10064330 - DNA, 22 bp, Homo sapiens
gtccactcccagtgcctgaggc

SEQ ID NO: 10064331 - DNA, 22 bp, Homo sapiens
gtcctgggcccaggggctgcct

SEQ ID NO: 10064332 - DNA, 22 bp, Homo sapiens
gtcctgggcctgctgaggctga

SEQ ID NO: 10064333 - DNA, 17 bp, Homo sapiens
gtcctgggaggagagag

SEQ ID NO: 10064334 - DNA, 22 bp, Homo sapiens
gtcctgggagatgggaccctga

SEQ ID NO: 10064335 - DNA, 22 bp, Homo sapiens
gtccctgccctcctgggactca

SEQ ID NO: 10064336 - DNA, 22 bp, Homo sapiens
gtctgcctcagccgggggccgc

SEQ ID NO: 10064337 - DNA, 22 bp, Homo sapiens
gtctgcctctattgcctacctg

SEQ ID NO: 10064338 - DNA, 22 bp, Homo sapiens
gtctgcctctttctttctgggt

SEQ ID NO: 10064339 - DNA, 22 bp, Homo sapiens
gtctgcctggaggcagctgctg

SEQ ID NO: 10064340 - DNA, 22 bp, Homo sapiens
gtctgcctgggacgctgggagt

SEQ ID NO: 10064341 - DNA, 22 bp, Homo sapiens
gtctgcctgtctggatgacaga

SEQ ID NO: 10064342 - DNA, 22 bp, Homo sapiens
gtctgcctgcaatccagagact

SEQ ID NO: 10064343 - DNA, 22 bp, Homo sapiens
gtctgcctgctagtggctgcct

SEQ ID NO: 10064344 - DNA, 18 bp, Homo sapiens
gtctgccttctcccttcc

SEQ ID NO: 10064345 - DNA, 22 bp, Homo sapiens
gtctgcctttatcatctcctta

SEQ ID NO: 10064346 - DNA, 22 bp, Homo sapiens
gtcctgggcggagggctgctgt

SEQ ID NO: 10064347 - DNA, 22 bp, Homo sapiens
gtgaaaagcaacattgtggacc

SEQ ID NO: 10064348 - DNA, 22 bp, Homo sapiens
gtgcacagattcagaggttttg

SEQ ID NO: 10064349 - DNA, 22 bp, Homo sapiens
gtgcacagaagcagaagctaga

SEQ ID NO: 10064350 - DNA, 22 bp, Homo sapiens
gtgagcagcctcacctgagggt

SEQ ID NO: 10064351 - DNA, 23 bp, Homo sapiens
gtgagcagcccactaggaatgcc

SEQ ID NO: 10064352 - DNA, 22 bp, Homo sapiens
ctggctcagacagctgtgcagt

SEQ ID NO: 10064353 - DNA, 22 bp, Homo sapiens
ctggctcattttagcatcaggt

SEQ ID NO: 10064354 - DNA, 22 bp, Homo sapiens
ctgccactttggagtgctcaga

SEQ ID NO: 10064355 - DNA, 22 bp, Homo sapiens
ctgccactctgggtgggcctgg

SEQ ID NO: 10064356 - DNA, 22 bp, Homo sapiens
ctgccactttcacccagtgctc

SEQ ID NO: 10064357 - DNA, 22 bp, Homo sapiens
ctgccagctcaccggctcagac

SEQ ID NO: 10064358 - DNA, 22 bp, Homo sapiens
ctgggctgcagcgggagcgacg

SEQ ID NO: 10064359 - DNA, 22 bp, Homo sapiens
ctgggctgccaggtaggcacac

SEQ ID NO: 10064360 - DNA, 22 bp, Homo sapiens
ctgggctgcggtggtaggttgt

SEQ ID NO: 10064361 - DNA, 22 bp, Homo sapiens
ctggggctcactttggtcaggc

SEQ ID NO: 10064362 - DNA, 22 bp, Homo sapiens
ctggggctgcggtggaggagcc

SEQ ID NO: 10064363 - DNA, 22 bp, Homo sapiens
ctgggaggcagaggttgcagtg

SEQ ID NO: 10064364 - DNA, 22 bp, Homo sapiens
ctgggaggcccacgttgggaag

SEQ ID NO: 10064365 - DNA, 22 bp, Homo sapiens
cttgtcttgcacacggttgcca

SEQ ID NO: 10064366 - DNA, 22 bp, Homo sapiens
cttgggggccattaaggggcct

SEQ ID NO: 10064367 - DNA, 22 bp, Homo sapiens
ctgttcctgtagagtccaagtc

SEQ ID NO: 10064368 - DNA, 23 bp, Homo sapiens
ctgtcctgccatccacagcggcc

SEQ ID NO: 10064369 - DNA, 22 bp, Homo sapiens
ctgtcctgaaagggagattggg

SEQ ID NO: 10064370 - DNA, 23 bp, Homo sapiens
ctgtcctgtagttcacgttggcc

SEQ ID NO: 10064371 - DNA, 22 bp, Homo sapiens
gaagccagtactgtgctctgca

SEQ ID NO: 10064372 - DNA, 22 bp, Homo sapiens
gaagccagccttgtctgcctct

SEQ ID NO: 10064373 - DNA, 22 bp, Homo sapiens
gaagccagcatccctctcccat

SEQ ID NO: 10064374 - DNA, 22 bp, Homo sapiens
gaacagggttgggtgagagagg

SEQ ID NO: 10064375 - DNA, 22 bp, Homo sapiens
gaacagggtttgagaggcttag

SEQ ID NO: 10064376 - DNA, 22 bp, Homo sapiens
gaacagcatgtaagaagctact

SEQ ID NO: 10064377 - DNA, 22 bp, Homo sapiens
gacaagggttctgcagagcctg

SEQ ID NO: 10064378 - DNA, 21 bp, Homo sapiens
gacaggggccatgggtttcta

SEQ ID NO: 10064379 - DNA, 21 bp, Homo sapiens
gacaggggaagaagcaaggag

SEQ ID NO: 10064380 - DNA, 22 bp, Homo sapiens
gacaggggtccctctgggctgt

SEQ ID NO: 10064381 - DNA, 22 bp, Homo sapiens
gacaggggctttgcatgcttta

SEQ ID NO: 10064382 - DNA, 22 bp, Homo sapiens
gacagggctgtgggaggagcag

SEQ ID NO: 10064383 - DNA, 23 bp, Homo sapiens
gacagggctgacttggcagctgc

SEQ ID NO: 10064384 - DNA, 22 bp, Homo sapiens
gacagtaagtcagagacttggt

SEQ ID NO: 10064385 - DNA, 22 bp, Homo sapiens
gaggaggcagcctatcccttag

SEQ ID NO: 10064386 - DNA, 22 bp, Homo sapiens
gagcctcctcctggtgtgccga

SEQ ID NO: 10064387 - DNA, 18 bp, Homo sapiens
gagctgagaagaggatgc

SEQ ID NO: 10064388 - DNA, 22 bp, Homo sapiens
gagcagccctagggcataagca

SEQ ID NO: 10064389 - DNA, 22 bp, Homo sapiens
gagcagcctgaggagcgtgggc

SEQ ID NO: 10064390 - DNA, 22 bp, Homo sapiens
gagccagggtttgaaactagac

SEQ ID NO: 10064391 - DNA, 17 bp, Homo sapiens
gagccaccctgtgcgag

SEQ ID NO: 10064392 - DNA, 22 bp, Homo sapiens
gagcagcaaagggagggtaaat

SEQ ID NO: 10064393 - DNA, 22 bp, Homo sapiens
gagcagcaggccaggttgcagg

SEQ ID NO: 10064394 - DNA, 18 bp, Homo sapiens
gagcagcaggatcaagaa

SEQ ID NO: 10064395 - DNA, 22 bp, Homo sapiens
gagcagcatctccggcttaaag

SEQ ID NO: 10064396 - DNA, 22 bp, Homo sapiens
gagcagcaggtggggctggctt

SEQ ID NO: 10064397 - DNA, 22 bp, Homo sapiens
gagaagggggctcgagtgtcct

SEQ ID NO: 10064398 - DNA, 22 bp, Homo sapiens
ctcacagatgctgtgggtcagg

SEQ ID NO: 10064399 - DNA, 22 bp, Homo sapiens
ctcacagagctcatactgggag

SEQ ID NO: 10064400 - DNA, 22 bp, Homo sapiens
ctcaagactgatcgcagtggaa

SEQ ID NO: 10064401 - DNA, 22 bp, Homo sapiens
ttctccttttccagttcccagt

SEQ ID NO: 10064402 - DNA, 22 bp, Homo sapiens
cgccctccacacagcccctggc

SEQ ID NO: 10064403 - DNA, 22 bp, Homo sapiens
ttcacactgtttttcatagtgg

SEQ ID NO: 10064404 - DNA, 22 bp, Homo sapiens
cctggtggacagcagccagcag

SEQ ID NO: 10064405 - DNA, 22 bp, Homo sapiens
cctgggctggagtacagcagtg

SEQ ID NO: 10064406 - DNA, 22 bp, Homo sapiens
tgtttagatgcaaagtctcaca

SEQ ID NO: 10064407 - DNA, 22 bp, Homo sapiens
cctgtctgcatgagtgagcata

SEQ ID NO: 10064408 - DNA, 21 bp, Homo sapiens
ccttctccacagggtctccgg

SEQ ID NO: 10064409 - DNA, 22 bp, Homo sapiens
ccttcccatgcagcctgtctga

SEQ ID NO: 10064410 - DNA, 22 bp, Homo sapiens
ccttccccaggtgctcactgtc

SEQ ID NO: 10064411 - DNA, 19 bp, Homo sapiens
ccttcctccccagggccat

SEQ ID NO: 10064412 - DNA, 22 bp, Homo sapiens
ttgtggttaaccgcacattttt

SEQ ID NO: 10064413 - DNA, 22 bp, Homo sapiens
ctccatggctttcgcatctgca

SEQ ID NO: 10064414 - DNA, 22 bp, Homo sapiens
ctcccaaggggtaagggagctg

SEQ ID NO: 10064415 - DNA, 22 bp, Homo sapiens
ctcccaggactcagaggagaag

SEQ ID NO: 10064416 - DNA, 22 bp, Homo sapiens
ctcccaggactggctctaactg

SEQ ID NO: 10064417 - DNA, 22 bp, Homo sapiens
ctcccaggccatgctctagcca

SEQ ID NO: 10064418 - DNA, 22 bp, Homo sapiens
ctcccaggcagggctgcccact

SEQ ID NO: 10064419 - DNA, 22 bp, Homo sapiens
ctcccaggcacagggaggagcc

SEQ ID NO: 10064420 - DNA, 22 bp, Homo sapiens
ctcccagggccatcgagtcact

SEQ ID NO: 10064421 - DNA, 22 bp, Homo sapiens
ctccaagggtcttccaccagga

SEQ ID NO: 10064422 - DNA, 22 bp, Homo sapiens
ctccaaggaagccccaagggat

SEQ ID NO: 10064423 - DNA, 22 bp, Homo sapiens
ctccacagcccctccagtggca

SEQ ID NO: 10064424 - DNA, 22 bp, Homo sapiens
ctccaaggttttccctgtcctt

SEQ ID NO: 10064425 - DNA, 17 bp, Homo sapiens
ctctccttcctctgagg

SEQ ID NO: 10064426 - DNA, 20 bp, Homo sapiens
ctcccctctacagagggctg

SEQ ID NO: 10064427 - DNA, 22 bp, Homo sapiens
ctcccctccttaggtcttctag

SEQ ID NO: 10064428 - DNA, 22 bp, Homo sapiens
ctcctccagtgggtccctcagg

SEQ ID NO: 10064429 - DNA, 22 bp, Homo sapiens
ctcctccagctctccctggggg

SEQ ID NO: 10064430 - DNA, 22 bp, Homo sapiens
ctcttcttggaatgctgactgt

SEQ ID NO: 10064431 - DNA, 22 bp, Homo sapiens
ctctgcctcccaggttcaagcg

SEQ ID NO: 10064432 - DNA, 19 bp, Homo sapiens
ctctgcctccctcctgggt

SEQ ID NO: 10064433 - DNA, 22 bp, Homo sapiens
ctctgcctcagtgatttcttta

SEQ ID NO: 10064434 - DNA, 19 bp, Homo sapiens
ctctgcctctggctgtggc

SEQ ID NO: 10064435 - DNA, 22 bp, Homo sapiens
tttgggactggagcttggagag

SEQ ID NO: 10064436 - DNA, 22 bp, Homo sapiens
ctgaatattagtcatgtctgat

SEQ ID NO: 10064437 - DNA, 22 bp, Homo sapiens
ctgaatatcatttatcattggc

SEQ ID NO: 10064438 - DNA, 22 bp, Homo sapiens
ctgcacacatatggcttctctc

SEQ ID NO: 10064439 - DNA, 22 bp, Homo sapiens
ctgcacagcatgctctgattta

SEQ ID NO: 10064440 - DNA, 22 bp, Homo sapiens
ctgcacagtcatttcctctcaa

SEQ ID NO: 10064441 - DNA, 22 bp, Homo sapiens
ctgcaggcatttattcatgcaa

SEQ ID NO: 10064442 - DNA, 22 bp, Homo sapiens
tggctgagaatgggatgatgcc

SEQ ID NO: 10064443 - DNA, 22 bp, Homo sapiens
tggggagcccactcacctcccc

SEQ ID NO: 10064444 - DNA, 22 bp, Homo sapiens
cctcagggacgggatcacttgg

SEQ ID NO: 10064445 - DNA, 22 bp, Homo sapiens
cctcagaggttctgtgtgggaa

SEQ ID NO: 10064446 - DNA, 19 bp, Homo sapiens
tggcccagatggtcctggg

SEQ ID NO: 10064447 - DNA, 22 bp, Homo sapiens
tggcctggggacctgtgagacc

SEQ ID NO: 10064448 - DNA, 22 bp, Homo sapiens
tggcctggggaagaccatgggc

SEQ ID NO: 10064449 - DNA, 22 bp, Homo sapiens
cctcagggactccatgctgcag

SEQ ID NO: 10064450 - DNA, 18 bp, Homo sapiens
cctcagggagatccagtg

SEQ ID NO: 10064451 - DNA, 22 bp, Homo sapiens
cctccaaccataggtccagggg

SEQ ID NO: 10064452 - DNA, 22 bp, Homo sapiens
cccttcctcctcgcctgtcaga

SEQ ID NO: 10064453 - DNA, 19 bp, Homo sapiens
tggcagaggacaaggactt

SEQ ID NO: 10064454 - DNA, 22 bp, Homo sapiens
cctcagaaggacaagagacaaa

SEQ ID NO: 10064455 - DNA, 22 bp, Homo sapiens
cctcagaggtgtggcatctctg

SEQ ID NO: 10064456 - DNA, 22 bp, Homo sapiens
cccaggctagtatgatatcagt

SEQ ID NO: 10064457 - DNA, 19 bp, Homo sapiens
cccaggctacatggagagg

SEQ ID NO: 10064458 - DNA, 22 bp, Homo sapiens
tgccagtgggtgtgcagagact

SEQ ID NO: 10064459 - DNA, 22 bp, Homo sapiens
tgccagtgtagtagctggttta

SEQ ID NO: 10064460 - DNA, 17 bp, Homo sapiens
cccagggaccactgctt

SEQ ID NO: 10064461 - DNA, 22 bp, Homo sapiens
cccagggacagatgggcagcta

SEQ ID NO: 10064462 - DNA, 22 bp, Homo sapiens
tgccttcctggagctgaaggct

SEQ ID NO: 10064463 - DNA, 22 bp, Homo sapiens
cccaggctggagggcagtgtca

SEQ ID NO: 10064464 - DNA, 22 bp, Homo sapiens
cccaggctggcactgctgaagt

SEQ ID NO: 10064465 - DNA, 22 bp, Homo sapiens
cccagggaaggcagatggagga

SEQ ID NO: 10064466 - DNA, 23 bp, Homo sapiens
cccagggacacgatgacacctcc

SEQ ID NO: 10064467 - DNA, 22 bp, Homo sapiens
ccctctccctgcagaatgtggc

SEQ ID NO: 10064468 - DNA, 22 bp, Homo sapiens
ccctctcctggctgcatggagc

SEQ ID NO: 10064469 - DNA, 22 bp, Homo sapiens
ccctcctggaggcggatgccca

SEQ ID NO: 10064470 - DNA, 22 bp, Homo sapiens
cccggacagaggggcagagtgt

SEQ ID NO: 10064471 - DNA, 22 bp, Homo sapiens
tcttcacattttagtggtttgt

SEQ ID NO: 10064472 - DNA, 22 bp, Homo sapiens
ccaggcagggagctgtttggcc

SEQ ID NO: 10064473 - DNA, 22 bp, Homo sapiens
ccaggcaggcgatggtgcagtg

SEQ ID NO: 10064474 - DNA, 22 bp, Homo sapiens
ccaggcaggctagaatgtaaat

SEQ ID NO: 10064475 - DNA, 22 bp, Homo sapiens
ccaggctctgtctggtcagaag

SEQ ID NO: 10064476 - DNA, 22 bp, Homo sapiens
ccaggctctgtgtgggctagag

SEQ ID NO: 10064477 - DNA, 21 bp, Homo sapiens
ccaggctcctgaggctggtca

SEQ ID NO: 10064478 - DNA, 23 bp, Homo sapiens
ccaggctctttcacctgctattc

SEQ ID NO: 10064479 - DNA, 22 bp, Homo sapiens
ccaggctctgttccccgaggag

SEQ ID NO: 10064480 - DNA, 22 bp, Homo sapiens
ccaggccattcccagagttgct

SEQ ID NO: 10064481 - DNA, 22 bp, Homo sapiens
tctcagaagggtggtgctggag

SEQ ID NO: 10064482 - DNA, 22 bp, Homo sapiens
tctcagaaggcaagggctgggg

SEQ ID NO: 10064483 - DNA, 22 bp, Homo sapiens
tctcagagaaatgtgtcaccat

SEQ ID NO: 10064484 - DNA, 22 bp, Homo sapiens
tctcagagaacagttggtgctt

SEQ ID NO: 10064485 - DNA, 22 bp, Homo sapiens
ccaggacactgcttcacagcag

SEQ ID NO: 10064486 - DNA, 22 bp, Homo sapiens
tgacatcattagtaacatagct

SEQ ID NO: 10064487 - DNA, 22 bp, Homo sapiens
tgagaaaaggttgagatgataa

SEQ ID NO: 10064488 - DNA, 22 bp, Homo sapiens
ccagtcccatctctgtcgctta

SEQ ID NO: 10064489 - DNA, 22 bp, Homo sapiens
tgcacagacaactctttctaga

SEQ ID NO: 10064490 - DNA, 22 bp, Homo sapiens
caggcagcagaggagtgtggga

SEQ ID NO: 10064491 - DNA, 22 bp, Homo sapiens
caggccaggtgctctagaatca

SEQ ID NO: 10064492 - DNA, 22 bp, Homo sapiens
caggccagtgggaaatagggat

SEQ ID NO: 10064493 - DNA, 19 bp, Homo sapiens
caggccagtgtcagggggc

SEQ ID NO: 10064494 - DNA, 22 bp, Homo sapiens
caggcatgatcataggagttta

SEQ ID NO: 10064495 - DNA, 22 bp, Homo sapiens
caggctggagttcagtggtgtg

SEQ ID NO: 10064496 - DNA, 22 bp, Homo sapiens
tagaaaagccccagctggaggg

SEQ ID NO: 10064497 - DNA, 22 bp, Homo sapiens
tagaaaagtatgggactgacat

SEQ ID NO: 10064498 - DNA, 22 bp, Homo sapiens
caggcctcttccatgcagcagc

SEQ ID NO: 10064499 - DNA, 22 bp, Homo sapiens
caggtaactttagtgaaagagc

SEQ ID NO: 10064500 - DNA, 22 bp, Homo sapiens
caggtaggaggctccctagtcc

SEQ ID NO: 10064501 - DNA, 22 bp, Homo sapiens
caggtaggttttaggctaaaca

SEQ ID NO: 10064502 - DNA, 22 bp, Homo sapiens
caggtgggtacatcacagagac

SEQ ID NO: 10064503 - DNA, 22 bp, Homo sapiens
caggtggcagaggtctctggaa

SEQ ID NO: 10064504 - DNA, 22 bp, Homo sapiens
caggtggagctgactgagggca

SEQ ID NO: 10064505 - DNA, 22 bp, Homo sapiens
caggtggccagtactcaaggat

SEQ ID NO: 10064506 - DNA, 22 bp, Homo sapiens
caggtggccttgccatctcctg

SEQ ID NO: 10064507 - DNA, 22 bp, Homo sapiens
cagggccagttctcgcagcagt

SEQ ID NO: 10064508 - DNA, 22 bp, Homo sapiens
cagggccactgtagatgaggag

SEQ ID NO: 10064509 - DNA, 22 bp, Homo sapiens
cagggccaggctgatggcctgg

SEQ ID NO: 10064510 - DNA, 22 bp, Homo sapiens
cagggagcaggctctgtccatc

SEQ ID NO: 10064511 - DNA, 22 bp, Homo sapiens
cagggagccccaattccatgcc

SEQ ID NO: 10064512 - DNA, 22 bp, Homo sapiens
cagggccattggcgtggctgtc

SEQ ID NO: 10064513 - DNA, 22 bp, Homo sapiens
cagggagcagcccctagaagta

SEQ ID NO: 10064514 - DNA, 22 bp, Homo sapiens
cagggagcagcgctggggcctc

SEQ ID NO: 10064515 - DNA, 22 bp, Homo sapiens
cagggagcagcatgggcaaagg

SEQ ID NO: 10064516 - DNA, 22 bp, Homo sapiens
cagggctccatgcagggactcc

SEQ ID NO: 10064517 - DNA, 22 bp, Homo sapiens
cagggctcttccggagcaggga

SEQ ID NO: 10064518 - DNA, 22 bp, Homo sapiens
taggctgggctgagctggacgg

SEQ ID NO: 10064519 - DNA, 18 bp, Homo sapiens
taggctgggggctgtagt

SEQ ID NO: 10064520 - DNA, 22 bp, Homo sapiens
cagggggtggtccaggctgcgc

SEQ ID NO: 10064521 - DNA, 22 bp, Homo sapiens
caggggtggctgcagcagaggt

SEQ ID NO: 10064522 - DNA, 22 bp, Homo sapiens
caggggcttaagtgacagaagg

SEQ ID NO: 10064523 - DNA, 22 bp, Homo sapiens
cagggggctgtggctgtccagt

SEQ ID NO: 10064524 - DNA, 22 bp, Homo sapiens
cagggggcagcgtagaaaatga

SEQ ID NO: 10064525 - DNA, 22 bp, Homo sapiens
cagggctgtctccaaaggcccc

SEQ ID NO: 10064526 - DNA, 22 bp, Homo sapiens
tcctgggactttcaaggctagg

SEQ ID NO: 10064527 - DNA, 18 bp, Homo sapiens
ccaaggcccctgctgggg

SEQ ID NO: 10064528 - DNA, 22 bp, Homo sapiens
tcctacagatactaaggagatc

SEQ ID NO: 10064529 - DNA, 22 bp, Homo sapiens
tccttcccaggtgtcgccgcct

SEQ ID NO: 10064530 - DNA, 22 bp, Homo sapiens
tccttgggtcagtgagtgaggt

SEQ ID NO: 10064531 - DNA, 19 bp, Homo sapiens
tccttccccccagcacaga

SEQ ID NO: 10064532 - DNA, 22 bp, Homo sapiens
tccttccccctcaagagaactt

SEQ ID NO: 10064533 - DNA, 21 bp, Homo sapiens
tccttcccccttggcctggga

SEQ ID NO: 10064534 - DNA, 20 bp, Homo sapiens
tccttccctctctttttgca

SEQ ID NO: 10064535 - DNA, 22 bp, Homo sapiens
tccttggggtaactccagcctg

SEQ ID NO: 10064536 - DNA, 23 bp, Homo sapiens
tccttgggcctgcccagagtggt

SEQ ID NO: 10064537 - DNA, 23 bp, Homo sapiens
catgggagtgagaatgccagctc

SEQ ID NO: 10064538 - DNA, 22 bp, Homo sapiens
catgggcagaagtggcatcatt

SEQ ID NO: 10064539 - DNA, 22 bp, Homo sapiens
catgggaggttggcttggcatg

SEQ ID NO: 10064540 - DNA, 22 bp, Homo sapiens
catgggccatggtgaagccagg

SEQ ID NO: 10064541 - DNA, 22 bp, Homo sapiens
cattagaaaagcagctgggacc

SEQ ID NO: 10064542 - DNA, 18 bp, Homo sapiens
tccctggggctgccaccc

SEQ ID NO: 10064543 - DNA, 22 bp, Homo sapiens
tccctgggtcctgcttgctctc

SEQ ID NO: 10064544 - DNA, 22 bp, Homo sapiens
tcccactcccaggcaggcctct

SEQ ID NO: 10064545 - DNA, 22 bp, Homo sapiens
tccctcctgcatgaggctcggc

SEQ ID NO: 10064546 - DNA, 22 bp, Homo sapiens
tcagagagttagtgtcttagct

SEQ ID NO: 10064547 - DNA, 22 bp, Homo sapiens
tcagagagtgcaaaatatagct

SEQ ID NO: 10064548 - DNA, 22 bp, Homo sapiens
tcagagagttacacaaattgtt

SEQ ID NO: 10064549 - DNA, 22 bp, Homo sapiens
tcagagcaaattcctgtgagcc

SEQ ID NO: 10064550 - DNA, 22 bp, Homo sapiens
tcagagcaacttttcctgcttt

SEQ ID NO: 10064551 - DNA, 22 bp, Homo sapiens
tcagagagtcctggtcatttgc

SEQ ID NO: 10064552 - DNA, 21 bp, Homo sapiens
tcagagagtcacagtgaactg

SEQ ID NO: 10064553 - DNA, 22 bp, Homo sapiens
tcagagaggttggtgataagaa

SEQ ID NO: 10064554 - DNA, 23 bp, Homo sapiens
tcagagcaagatgatgtatgagc

SEQ ID NO: 10064555 - DNA, 22 bp, Homo sapiens
tcaggcagagtggaagctgcaa

SEQ ID NO: 10064556 - DNA, 22 bp, Homo sapiens
tcaggcctcagcagcccacagg

SEQ ID NO: 10064557 - DNA, 22 bp, Homo sapiens
catgcacacacgtgcatgtacg

SEQ ID NO: 10064558 - DNA, 22 bp, Homo sapiens
catgaaggctgccagcaggcat

SEQ ID NO: 10064559 - DNA, 22 bp, Homo sapiens
catctgatgggaatataagagc

SEQ ID NO: 10064560 - DNA, 19 bp, Homo sapiens
tcagggagtttacagcatg

SEQ ID NO: 10064561 - DNA, 22 bp, Homo sapiens
tttggacttagcctgcagaatt

SEQ ID NO: 10064562 - DNA, 22 bp, Homo sapiens
tttggactatctgtgtggcttt

SEQ ID NO: 10064563 - DNA, 22 bp, Homo sapiens
ttggtcttcagagatctggtgg

SEQ ID NO: 10064564 - DNA, 22 bp, Homo sapiens
ttggtcttgagtggcttgttaa

SEQ ID NO: 10064565 - DNA, 22 bp, Homo sapiens
ttggtcctcagtttccctatct

SEQ ID NO: 10064566 - DNA, 22 bp, Homo sapiens
ttggtcctgcagaggggtctgg

SEQ ID NO: 10064567 - DNA, 22 bp, Homo sapiens
ttggtcctgccccctccaggtc

SEQ ID NO: 10064568 - DNA, 17 bp, Homo sapiens
tttctccttccatctca

SEQ ID NO: 10064569 - DNA, 22 bp, Homo sapiens
tttctcctgtgaggtcagaagt

SEQ ID NO: 10064570 - DNA, 22 bp, Homo sapiens
tttctcctgtgtaagccgccca

SEQ ID NO: 10064571 - DNA, 22 bp, Homo sapiens
tttctcctgagttccacgctac

SEQ ID NO: 10064572 - DNA, 22 bp, Homo sapiens
tttctcctgctagaacaaggag

SEQ ID NO: 10064573 - DNA, 22 bp, Homo sapiens
tttctcagcctccttgctggag

SEQ ID NO: 10064574 - DNA, 22 bp, Homo sapiens
tgttcctgtgtggaaaagggcc

SEQ ID NO: 10064575 - DNA, 22 bp, Homo sapiens
tgttcctgacggccaaagaggt

SEQ ID NO: 10064576 - DNA, 22 bp, Homo sapiens
tgtgtttgaggcatgttgcaga

SEQ ID NO: 10064577 - DNA, 22 bp, Homo sapiens
tcccctcccttccaacagagct

SEQ ID NO: 10064578 - DNA, 23 bp, Homo sapiens
tcccctcaggcagccagtgccct

SEQ ID NO: 10064579 - DNA, 22 bp, Homo sapiens
tcccctcccttccaacagagct

SEQ ID NO: 10064580 - DNA, 22 bp, Homo sapiens
tgtggcagtaaaattgggcaac

SEQ ID NO: 10064581 - DNA, 22 bp, Homo sapiens
tgtggcagtctcactggagggc

SEQ ID NO: 10064582 - DNA, 22 bp, Homo sapiens
tgtggcagaggaggcagcgtcc

SEQ ID NO: 10064583 - DNA, 22 bp, Homo sapiens
tgtggcagaactgggactcaaa

SEQ ID NO: 10064584 - DNA, 21 bp, Homo sapiens
tgtggcagagacaatgctagt

SEQ ID NO: 10064585 - DNA, 21 bp, Homo sapiens
tgtggcagatgttgggaggca

SEQ ID NO: 10064586 - DNA, 22 bp, Homo sapiens
tgtggcagatacagaagatcaa

SEQ ID NO: 10064587 - DNA, 22 bp, Homo sapiens
tgtggcagaaagcatgtggaca

SEQ ID NO: 10064588 - DNA, 22 bp, Homo sapiens
tgtggtttttcagttgctggag

SEQ ID NO: 10064589 - DNA, 19 bp, Homo sapiens
tgtggtttcccggcggcct

SEQ ID NO: 10064590 - DNA, 22 bp, Homo sapiens
tgtggtttactgtggcgctgct

SEQ ID NO: 10064591 - DNA, 22 bp, Homo sapiens
tgtgtctttgttccaggtacga

SEQ ID NO: 10064592 - DNA, 22 bp, Homo sapiens
ttaattgatataaagaacttca

SEQ ID NO: 10064593 - DNA, 23 bp, Homo sapiens
ttaagtggtcagttttagacaac

SEQ ID NO: 10064594 - DNA, 18 bp, Homo sapiens
ttaagtgctatgcaattg

SEQ ID NO: 10064595 - DNA, 22 bp, Homo sapiens
ttcctctgtatgctttgctgct

SEQ ID NO: 10064596 - DNA, 22 bp, Homo sapiens
ttcctcagagggcgctggggaa

SEQ ID NO: 10064597 - DNA, 19 bp, Homo sapiens
ttccttagaggaggcggtg

SEQ ID NO: 10064598 - DNA, 22 bp, Homo sapiens
ttctgccttacgatattttcaa

SEQ ID NO: 10064599 - DNA, 22 bp, Homo sapiens
ttctgcctggcaggaggactgt

SEQ ID NO: 10064600 - DNA, 22 bp, Homo sapiens
ttctgcctgccccagagaggcc

SEQ ID NO: 10064601 - DNA, 22 bp, Homo sapiens
ttctgccttggcagggtggtcc

SEQ ID NO: 10064602 - DNA, 21 bp, Homo sapiens
ttctgccttcgaggtctcagg

SEQ ID NO: 10064603 - DNA, 22 bp, Homo sapiens
ttctgccttcagtcctctgact

SEQ ID NO: 10064604 - DNA, 21 bp, Homo sapiens
ttctgccttcccctagctggg

SEQ ID NO: 10064605 - DNA, 22 bp, Homo sapiens
ttgagcaggaactagaagatag

SEQ ID NO: 10064606 - DNA, 22 bp, Homo sapiens
ctgccctgacctgcctcagagt

SEQ ID NO: 10064607 - DNA, 18 bp, Homo sapiens
ctgcctgctctccagctt

SEQ ID NO: 10064608 - DNA, 22 bp, Homo sapiens
ctgcctgctgccctccagagcc

SEQ ID NO: 10064609 - DNA, 22 bp, Homo sapiens
ctgcctgcttctgagccagagg

SEQ ID NO: 10064610 - DNA, 22 bp, Homo sapiens
ctgccctgtctgcagcctggct

SEQ ID NO: 10064611 - DNA, 22 bp, Homo sapiens
ctgccctgtggctctgagtcat

SEQ ID NO: 10064612 - DNA, 22 bp, Homo sapiens
atctccagtcctggtttcctgg

SEQ ID NO: 10064613 - DNA, 18 bp, Homo sapiens
atctcccattggccaagg

SEQ ID NO: 10064614 - DNA, 22 bp, Homo sapiens
atctcccaaattagcctcttga

SEQ ID NO: 10064615 - DNA, 22 bp, Homo sapiens
atctggaagccagatactcagt

SEQ ID NO: 10064616 - DNA, 22 bp, Homo sapiens
cttcagaattcctcagcctcag

SEQ ID NO: 10064617 - DNA, 22 bp, Homo sapiens
cttcagagtgactcagcatctt

SEQ ID NO: 10064618 - DNA, 22 bp, Homo sapiens
atccttccagagttattctcaa

SEQ ID NO: 10064619 - DNA, 22 bp, Homo sapiens
atccttccttcatttgacaggt

SEQ ID NO: 10064620 - DNA, 22 bp, Homo sapiens
ctgggctgtaatgtggcactga

SEQ ID NO: 10064621 - DNA, 22 bp, Homo sapiens
ctgtatggtccacgtgggtgcc

SEQ ID NO: 10064622 - DNA, 22 bp, Homo sapiens
ctggggaggcagggctgcccct

SEQ ID NO: 10064623 - DNA, 22 bp, Homo sapiens
ctcctctccatcagcgccaccc

SEQ ID NO: 10064624 - DNA, 22 bp, Homo sapiens
ctcctccctctttgccacacat

SEQ ID NO: 10064625 - DNA, 22 bp, Homo sapiens
ctcctcccacggtctcaggaag

SEQ ID NO: 10064626 - DNA, 22 bp, Homo sapiens
ctcctccctgggaggctggcat

SEQ ID NO: 10064627 - DNA, 22 bp, Homo sapiens
ctcctcctggacacaggctgtg

SEQ ID NO: 10064628 - DNA, 22 bp, Homo sapiens
ctcccagggtagggagagacta

SEQ ID NO: 10064629 - DNA, 22 bp, Homo sapiens
ctcccagggtctaggctgctgg

SEQ ID NO: 10064630 - DNA, 22 bp, Homo sapiens
ctcccaggggagtcatctgctt

SEQ ID NO: 10064631 - DNA, 22 bp, Homo sapiens
ctcctcccacggtctcaggaag

SEQ ID NO: 10064632 - DNA, 22 bp, Homo sapiens
ctcctcagctgggaggagtccc

SEQ ID NO: 10064633 - DNA, 22 bp, Homo sapiens
ctcccaggttccgacgcctctt

SEQ ID NO: 10064634 - DNA, 22 bp, Homo sapiens
ctcccaggttacatctgagcct

SEQ ID NO: 10064635 - DNA, 21 bp, Homo sapiens
ctcccagggtgactgttcaac

SEQ ID NO: 10064636 - DNA, 22 bp, Homo sapiens
ctcccaggtgtcccttctgcca

SEQ ID NO: 10064637 - DNA, 22 bp, Homo sapiens
agtgactggtgtgaagttaaat

SEQ ID NO: 10064638 - DNA, 22 bp, Homo sapiens
agtgcacttttgggggatgtta

SEQ ID NO: 10064639 - DNA, 22 bp, Homo sapiens
agtgcactgagctaggagtgga

SEQ ID NO: 10064640 - DNA, 22 bp, Homo sapiens
agtgcagatttttagtcagctt

SEQ ID NO: 10064641 - DNA, 22 bp, Homo sapiens
agtgacaggggaggcaggtgtg

SEQ ID NO: 10064642 - DNA, 22 bp, Homo sapiens
agtgacagtttcaggcattttt

SEQ ID NO: 10064643 - DNA, 22 bp, Homo sapiens
ctctgagaggatcctgcccggg

SEQ ID NO: 10064644 - DNA, 22 bp, Homo sapiens
agtgggcaaaacagctcagagc

SEQ ID NO: 10064645 - DNA, 22 bp, Homo sapiens
agtgggatgcaataaagatata

SEQ ID NO: 10064646 - DNA, 22 bp, Homo sapiens
agtgggagggccatatggtgaa

SEQ ID NO: 10064647 - DNA, 20 bp, Homo sapiens
agtggcaggcgatcattact

SEQ ID NO: 10064648 - DNA, 22 bp, Homo sapiens
agtggcagccgagcaggagatg

SEQ ID NO: 10064649 - DNA, 22 bp, Homo sapiens
agtggcagccttgttcattatg

SEQ ID NO: 10064650 - DNA, 22 bp, Homo sapiens
agtgcaggccccaggccaggcc

SEQ ID NO: 10064651 - DNA, 22 bp, Homo sapiens
ctgaagcaattgagagatgttt

SEQ ID NO: 10064652 - DNA, 22 bp, Homo sapiens
cgtgagcaaaatggacactccc

SEQ ID NO: 10064653 - DNA, 22 bp, Homo sapiens
cgtgagcagctctgtgtctctg

SEQ ID NO: 10064654 - DNA, 22 bp, Homo sapiens
cgcctttaaattgttttacact

SEQ ID NO: 10064655 - DNA, 22 bp, Homo sapiens
cctgcctggctgtcagcagagc

SEQ ID NO: 10064656 - DNA, 22 bp, Homo sapiens
cctgcctggagctgagtgtgga

SEQ ID NO: 10064657 - DNA, 22 bp, Homo sapiens
cctgcctggcttccagaagaga

SEQ ID NO: 10064658 - DNA, 22 bp, Homo sapiens
cctgggcagggctggactctca

SEQ ID NO: 10064659 - DNA, 22 bp, Homo sapiens
aggtggagtgtgcagggagagc

SEQ ID NO: 10064660 - DNA, 21 bp, Homo sapiens
cccagggaagccgcagtcacc

SEQ ID NO: 10064661 - DNA, 22 bp, Homo sapiens
cccaggatggggctgcagttat

SEQ ID NO: 10064662 - DNA, 23 bp, Homo sapiens
agggaacaagcaagctgctagtc

SEQ ID NO: 10064663 - DNA, 20 bp, Homo sapiens
agggaacaatggacgctgtc

SEQ ID NO: 10064664 - DNA, 23 bp, Homo sapiens
cccaggagtttcactgcaaaggt

SEQ ID NO: 10064665 - DNA, 22 bp, Homo sapiens
cccaggagtttgagttcagcat

SEQ ID NO: 10064666 - DNA, 21 bp, Homo sapiens
aggcttggatagatattcata

SEQ ID NO: 10064667 - DNA, 22 bp, Homo sapiens
ccctccccacaaagcttcacac

SEQ ID NO: 10064668 - DNA, 20 bp, Homo sapiens
agggcagagggattacaggc

SEQ ID NO: 10064669 - DNA, 22 bp, Homo sapiens
agggcagagagatgaatgggat

SEQ ID NO: 10064670 - DNA, 22 bp, Homo sapiens
agggcagagatctgagtgggca

SEQ ID NO: 10064671 - DNA, 22 bp, Homo sapiens
agggactcggttgagtgcccct

SEQ ID NO: 10064672 - DNA, 22 bp, Homo sapiens
agggactcctctgctcggctgc

SEQ ID NO: 10064673 - DNA, 17 bp, Homo sapiens
aggggagagtgggaaga

SEQ ID NO: 10064674 - DNA, 18 bp, Homo sapiens
cctctgccatagccagca

SEQ ID NO: 10064675 - DNA, 22 bp, Homo sapiens
cctctgggcctggaagggcagt

SEQ ID NO: 10064676 - DNA, 22 bp, Homo sapiens
cctctgggcaggtagcagcagc

SEQ ID NO: 10064677 - DNA, 22 bp, Homo sapiens
cctctgggcaggtagcagcagc

SEQ ID NO: 10064678 - DNA, 22 bp, Homo sapiens
cctctgggagactgctactgag

SEQ ID NO: 10064679 - DNA, 22 bp, Homo sapiens
agggccagagtacatcagggct

SEQ ID NO: 10064680 - DNA, 22 bp, Homo sapiens
cccttcccttctgggagatcca

SEQ ID NO: 10064681 - DNA, 22 bp, Homo sapiens
agggccctccccgctcagggca

SEQ ID NO: 10064682 - DNA, 22 bp, Homo sapiens
agggctccaggggctgggtgac

SEQ ID NO: 10064683 - DNA, 22 bp, Homo sapiens
agggctcccgtgaggtgactgc

SEQ ID NO: 10064684 - DNA, 22 bp, Homo sapiens
agggctcataattcctgacttc

SEQ ID NO: 10064685 - DNA, 21 bp, Homo sapiens
agggctcaaatgtgcttgctg

SEQ ID NO: 10064686 - DNA, 22 bp, Homo sapiens
agggctcattgacatggaaaag

SEQ ID NO: 10064687 - DNA, 22 bp, Homo sapiens
agggctcctatgatgctctgcc

SEQ ID NO: 10064688 - DNA, 22 bp, Homo sapiens
agggctcctccccggcctccac

SEQ ID NO: 10064689 - DNA, 22 bp, Homo sapiens
agggctcctatgccccatggac

SEQ ID NO: 10064690 - DNA, 22 bp, Homo sapiens
agggctctcttcttggtttgca

SEQ ID NO: 10064691 - DNA, 22 bp, Homo sapiens
agggctcctgaggcccttctgg

SEQ ID NO: 10064692 - DNA, 22 bp, Homo sapiens
cctccccacgggcagccggcgc

SEQ ID NO: 10064693 - DNA, 17 bp, Homo sapiens
ccagggaggggccgcgc

SEQ ID NO: 10064694 - DNA, 22 bp, Homo sapiens
aggctcctgatcctggggtctg

SEQ ID NO: 10064695 - DNA, 22 bp, Homo sapiens
aggctcctgcaggccttgtagg

SEQ ID NO: 10064696 - DNA, 20 bp, Homo sapiens
aggctcctgtacctgaggaa

SEQ ID NO: 10064697 - DNA, 22 bp, Homo sapiens
aggctcaggtgcctcattcaca

SEQ ID NO: 10064698 - DNA, 22 bp, Homo sapiens
aggctcagtatagctggcaagt

SEQ ID NO: 10064699 - DNA, 22 bp, Homo sapiens
aggctcagtctgttcatgcact

SEQ ID NO: 10064700 - DNA, 22 bp, Homo sapiens
aggctcagtcccggcccgcgcc

SEQ ID NO: 10064701 - DNA, 22 bp, Homo sapiens
aggctcagtgatgtaaaatata

SEQ ID NO: 10064702 - DNA, 22 bp, Homo sapiens
aggctcagtttggtttccattg

SEQ ID NO: 10064703 - DNA, 22 bp, Homo sapiens
aggctcagttctgtggtgagcc

SEQ ID NO: 10064704 - DNA, 22 bp, Homo sapiens
aggctcagttcacgtcaacttt

SEQ ID NO: 10064705 - DNA, 22 bp, Homo sapiens
aggctcagtgcaaatcattctg

SEQ ID NO: 10064706 - DNA, 22 bp, Homo sapiens
ccatgtactactttctgagctc

SEQ ID NO: 10064707 - DNA, 22 bp, Homo sapiens
aggctctgtgcatcctccccaa

SEQ ID NO: 10064708 - DNA, 22 bp, Homo sapiens
ccagcctccatgtagatagctg

SEQ ID NO: 10064709 - DNA, 19 bp, Homo sapiens
ccagctggcctgggacctc

SEQ ID NO: 10064710 - DNA, 22 bp, Homo sapiens
aggcagggtcttgctatgttgc

SEQ ID NO: 10064711 - DNA, 21 bp, Homo sapiens
aggcatggaaatggcacactg

SEQ ID NO: 10064712 - DNA, 23 bp, Homo sapiens
aggcatggcatggatggtggctc

SEQ ID NO: 10064713 - DNA, 22 bp, Homo sapiens
aggcatggcactgagcagcttc

SEQ ID NO: 10064714 - DNA, 22 bp, Homo sapiens
caggctcagatgccctgcgctg

SEQ ID NO: 10064715 - DNA, 22 bp, Homo sapiens
caggctcagcaggagcctgacc

SEQ ID NO: 10064716 - DNA, 22 bp, Homo sapiens
caggctcagaagccagtggagc

SEQ ID NO: 10064717 - DNA, 22 bp, Homo sapiens
agctgtggaagactgtcagggt

SEQ ID NO: 10064718 - DNA, 19 bp, Homo sapiens
cagggatgggtagggactc

SEQ ID NO: 10064719 - DNA, 22 bp, Homo sapiens
cagggatggcgctggctgcccg

SEQ ID NO: 10064720 - DNA, 22 bp, Homo sapiens
cagggagctggctggctgtgcc

SEQ ID NO: 10064721 - DNA, 22 bp, Homo sapiens
caggctggagtgcagtggtgcc

SEQ ID NO: 10064722 - DNA, 22 bp, Homo sapiens
caggctggagtgcagttgtgca

SEQ ID NO: 10064723 - DNA, 22 bp, Homo sapiens
cagggctcgctcttgcccttcg

SEQ ID NO: 10064724 - DNA, 22 bp, Homo sapiens
cagggctcgctcgctcgctcgc

SEQ ID NO: 10064725 - DNA, 22 bp, Homo sapiens
cagggctcgctgccagcttcag

SEQ ID NO: 10064726 - DNA, 22 bp, Homo sapiens
cagggctctgccttgagggatg

SEQ ID NO: 10064727 - DNA, 22 bp, Homo sapiens
cagggctccctctggctcccag

SEQ ID NO: 10064728 - DNA, 22 bp, Homo sapiens
cagggctccccagagagcctct

SEQ ID NO: 10064729 - DNA, 23 bp, Homo sapiens
cagggccaggcagcagctgtcac

SEQ ID NO: 10064730 - DNA, 22 bp, Homo sapiens
caggggctgtgggcggagcctc

SEQ ID NO: 10064731 - DNA, 22 bp, Homo sapiens
caggggctgtggcacatggtgt

SEQ ID NO: 10064732 - DNA, 22 bp, Homo sapiens
caggggctgaaatgttggggtt

SEQ ID NO: 10064733 - DNA, 22 bp, Homo sapiens
caggcactgtgttaggcactgt

SEQ ID NO: 10064734 - DNA, 22 bp, Homo sapiens
caggagcccagagtcctcagct

SEQ ID NO: 10064735 - DNA, 22 bp, Homo sapiens
caggaggaggtgaggtagaact

SEQ ID NO: 10064736 - DNA, 22 bp, Homo sapiens
caggcactggggatgctgggat

SEQ ID NO: 10064737 - DNA, 22 bp, Homo sapiens
caggcactggccagtcagcaca

SEQ ID NO: 10064738 - DNA, 22 bp, Homo sapiens
cagctgacagtgaggtgggggc

SEQ ID NO: 10064739 - DNA, 22 bp, Homo sapiens
cagctgacccagtgaggaggca

SEQ ID NO: 10064740 - DNA, 22 bp, Homo sapiens
cagctgacttcataggaagaca

SEQ ID NO: 10064741 - DNA, 22 bp, Homo sapiens
cagctgacctggctaagggagc

SEQ ID NO: 10064742 - DNA, 23 bp, Homo sapiens
agctgaggctgtgggtgtcagag

SEQ ID NO: 10064743 - DNA, 22 bp, Homo sapiens
cagctgagaccagaatgcaggt

SEQ ID NO: 10064744 - DNA, 22 bp, Homo sapiens
cagctgagaaatggggaaaggg

SEQ ID NO: 10064745 - DNA, 22 bp, Homo sapiens
cagctgagaaaggcaggctcac

SEQ ID NO: 10064746 - DNA, 22 bp, Homo sapiens
caggaaggggctcactctggcc

SEQ ID NO: 10064747 - DNA, 22 bp, Homo sapiens
caggaaggcgcggctgtgcctg

SEQ ID NO: 10064748 - DNA, 22 bp, Homo sapiens
caggaaggcccacctgtcctgt

SEQ ID NO: 10064749 - DNA, 22 bp, Homo sapiens
cagtgcctgccttttattttgt

SEQ ID NO: 10064750 - DNA, 22 bp, Homo sapiens
cagtgctcatagctgttcctcc

SEQ ID NO: 10064751 - DNA, 22 bp, Homo sapiens
cagtgctcctgatgtacccttg

SEQ ID NO: 10064752 - DNA, 22 bp, Homo sapiens
caggtggcttctccctaggcca

SEQ ID NO: 10064753 - DNA, 22 bp, Homo sapiens
caggtgggaccatgatagggca

SEQ ID NO: 10064754 - DNA, 22 bp, Homo sapiens
caggtgggaccatgatagggca

SEQ ID NO: 10064755 - DNA, 22 bp, Homo sapiens
caggtgggagcgaggagctact

SEQ ID NO: 10064756 - DNA, 22 bp, Homo sapiens
caggtgggagcggagactgatt

SEQ ID NO: 10064757 - DNA, 22 bp, Homo sapiens
caggtgggagcggagactgatt

SEQ ID NO: 10064758 - DNA, 22 bp, Homo sapiens
cagtggcgtgatctctgctcac

SEQ ID NO: 10064759 - DNA, 22 bp, Homo sapiens
catgggctgaaaatctgcaaac

SEQ ID NO: 10064760 - DNA, 22 bp, Homo sapiens
ccaaaggcggaactgagtctct

SEQ ID NO: 10064761 - DNA, 22 bp, Homo sapiens
aggcactgtggaagacatggtt

SEQ ID NO: 10064762 - DNA, 22 bp, Homo sapiens
cagagccactgcattttacagc

SEQ ID NO: 10064763 - DNA, 22 bp, Homo sapiens
cagagcagtggggttggtcaga

SEQ ID NO: 10064764 - DNA, 22 bp, Homo sapiens
cagagcagtggagagtaggtct

SEQ ID NO: 10064765 - DNA, 22 bp, Homo sapiens
cagagcagaagcggtcctcaca

SEQ ID NO: 10064766 - DNA, 22 bp, Homo sapiens
cagagaggaggctatatgcaaa

SEQ ID NO: 10064767 - DNA, 22 bp, Homo sapiens
cagagcagaaacctgggtgatt

SEQ ID NO: 10064768 - DNA, 22 bp, Homo sapiens
cagagcagaagcggtcctcaca

SEQ ID NO: 10064769 - DNA, 22 bp, Homo sapiens
cagagacaacctggtagagaaa

SEQ ID NO: 10064770 - DNA, 22 bp, Homo sapiens
gggagctgcacacgccccggaa

SEQ ID NO: 10064771 - DNA, 22 bp, Homo sapiens
cagacacacaccctggcctagc

SEQ ID NO: 10064772 - DNA, 22 bp, Homo sapiens
cagacacagatatgcatatggc

SEQ ID NO: 10064773 - DNA, 22 bp, Homo sapiens
gggagctgccttagaccggagg

SEQ ID NO: 10064774 - DNA, 22 bp, Homo sapiens
gggctggaggtgagcaggacag

SEQ ID NO: 10064775 - DNA, 22 bp, Homo sapiens
gggctggagtcttctgaaagcc

SEQ ID NO: 10064776 - DNA, 22 bp, Homo sapiens
gggctgtaggagctggaatggg

SEQ ID NO: 10064777 - DNA, 21 bp, Homo sapiens
gggctggatattggaaagagg

SEQ ID NO: 10064778 - DNA, 22 bp, Homo sapiens
gggctggagttgggaagacaaa

SEQ ID NO: 10064779 - DNA, 22 bp, Homo sapiens
ggggagcttggttattcatgca

SEQ ID NO: 10064780 - DNA, 20 bp, Homo sapiens
gggtacagatatgcagtgaa

SEQ ID NO: 10064781 - DNA, 22 bp, Homo sapiens
gggtacagaaactgaggcttag

SEQ ID NO: 10064782 - DNA, 21 bp, Homo sapiens
ggggttggcaagagcagagac

SEQ ID NO: 10064783 - DNA, 20 bp, Homo sapiens
ggggttggctggcacaggga

SEQ ID NO: 10064784 - DNA, 21 bp, Homo sapiens
gggtagcagaggaggccgtgg

SEQ ID NO: 10064785 - DNA, 22 bp, Homo sapiens
gggtgttgattttacactaaaa

SEQ ID NO: 10064786 - DNA, 22 bp, Homo sapiens
gggttaggttctagaggcacaa

SEQ ID NO: 10064787 - DNA, 22 bp, Homo sapiens
cagatgaggacagatgactggg

SEQ ID NO: 10064788 - DNA, 23 bp, Homo sapiens
gtgagcagcaccatgaggctaga

SEQ ID NO: 10064789 - DNA, 18 bp, Homo sapiens
gtgagcagagagcatcac

SEQ ID NO: 10064790 - DNA, 22 bp, Homo sapiens
gtgagcagacatcaaaggctgc

SEQ ID NO: 10064791 - DNA, 22 bp, Homo sapiens
cagccaggcccagatcatgctg

SEQ ID NO: 10064792 - DNA, 22 bp, Homo sapiens
cagccaggagcctctgcaacta

SEQ ID NO: 10064793 - DNA, 22 bp, Homo sapiens
cagccaggagctccccctgctc

SEQ ID NO: 10064794 - DNA, 22 bp, Homo sapiens
cagccagcttcagatccaagcc

SEQ ID NO: 10064795 - DNA, 22 bp, Homo sapiens
cagcatctctgcctgcctgcaa

SEQ ID NO: 10064796 - DNA, 22 bp, Homo sapiens
gtcacactcttccctccacatg

SEQ ID NO: 10064797 - DNA, 20 bp, Homo sapiens
cagcagccaaacttctattc

SEQ ID NO: 10064798 - DNA, 22 bp, Homo sapiens
cacaggggcaaactgtagggga

SEQ ID NO: 10064799 - DNA, 18 bp, Homo sapiens
cacaggcaggtgataggt

SEQ ID NO: 10064800 - DNA, 22 bp, Homo sapiens
cacagggcaggtactctcagag

SEQ ID NO: 10064801 - DNA, 23 bp, Homo sapiens
cacaggtgtttcatcttctcagt

SEQ ID NO: 10064802 - DNA, 20 bp, Homo sapiens
ggcagatgcagagctatgca

SEQ ID NO: 10064803 - DNA, 22 bp, Homo sapiens
caccactggaggtcttggcttt

SEQ ID NO: 10064804 - DNA, 22 bp, Homo sapiens
cacctgggctttctctgggact

SEQ ID NO: 10064805 - DNA, 22 bp, Homo sapiens
cactcccttcaggagcctagga

SEQ ID NO: 10064806 - DNA, 23 bp, Homo sapiens
cactcctgtttctaagccagcat

SEQ ID NO: 10064807 - DNA, 21 bp, Homo sapiens
cactctcccaatccttgctga

SEQ ID NO: 10064808 - DNA, 22 bp, Homo sapiens
cacttgggagcattgcacatgt

SEQ ID NO: 10064809 - DNA, 22 bp, Homo sapiens
ggctggatgtactttggggctg

SEQ ID NO: 10064810 - DNA, 22 bp, Homo sapiens
cacttgggacaaagcttctgct

SEQ ID NO: 10064811 - DNA, 22 bp, Homo sapiens
cactgcactccagctgggtgac

SEQ ID NO: 10064812 - DNA, 22 bp, Homo sapiens
ggacatggagctccatggaggc

SEQ ID NO: 10064813 - DNA, 22 bp, Homo sapiens
ggacatggaagtatggagtgga

SEQ ID NO: 10064814 - DNA, 22 bp, Homo sapiens
ggactgggtaggagcccagggc

SEQ ID NO: 10064815 - DNA, 22 bp, Homo sapiens
gctgccacgaggtttccttatc

SEQ ID NO: 10064816 - DNA, 22 bp, Homo sapiens
caagcctcagaatcttctccat

SEQ ID NO: 10064817 - DNA, 22 bp, Homo sapiens
caagcccactgctcagagccaa

SEQ ID NO: 10064818 - DNA, 17 bp, Homo sapiens
gctggctgacccatgcc

SEQ ID NO: 10064819 - DNA, 22 bp, Homo sapiens
gccttcccaagacgcctgagtt

SEQ ID NO: 10064820 - DNA, 22 bp, Homo sapiens
gccttccctctcatcctgctgg

SEQ ID NO: 10064821 - DNA, 22 bp, Homo sapiens
gccttcccaccctgcgaggctg

SEQ ID NO: 10064822 - DNA, 19 bp, Homo sapiens
gccttcccaccacccgtcc

SEQ ID NO: 10064823 - DNA, 22 bp, Homo sapiens
gccttccctggctaggcaagca

SEQ ID NO: 10064824 - DNA, 22 bp, Homo sapiens
attttccttgtgggttagcgaa

SEQ ID NO: 10064825 - DNA, 22 bp, Homo sapiens
gctcccaggcatggaggtaatt

SEQ ID NO: 10064826 - DNA, 22 bp, Homo sapiens
gctcccagggacactggccact

SEQ ID NO: 10064827 - DNA, 22 bp, Homo sapiens
gctcccagttcccaaagtgacc

SEQ ID NO: 10064828 - DNA, 22 bp, Homo sapiens
gctcccaggttcttgggccttg

SEQ ID NO: 10064829 - DNA, 22 bp, Homo sapiens
gctcccagggcagcgcagaaga

SEQ ID NO: 10064830 - DNA, 22 bp, Homo sapiens
gctcagagaatttactgctgcc

SEQ ID NO: 10064831 - DNA, 22 bp, Homo sapiens
gctcagagaaagattagtccct

SEQ ID NO: 10064832 - DNA, 22 bp, Homo sapiens
gctcagagaaaactggggcttg

SEQ ID NO: 10064833 - DNA, 22 bp, Homo sapiens
gccttctccctaaccaaatcct

SEQ ID NO: 10064834 - DNA, 22 bp, Homo sapiens
gcccaggttggagagcagtggc

SEQ ID NO: 10064835 - DNA, 22 bp, Homo sapiens
gccagccataggccagcactgg

SEQ ID NO: 10064836 - DNA, 20 bp, Homo sapiens
gcagggcatcttggccccca

SEQ ID NO: 10064837 - DNA, 22 bp, Homo sapiens
gcagggcatagaggcacggagg

SEQ ID NO: 10064838 - DNA, 22 bp, Homo sapiens
gcagggcatccctgagcgggtg

SEQ ID NO: 10064839 - DNA, 20 bp, Homo sapiens
gcaggcagggaatgggggtg

SEQ ID NO: 10064840 - DNA, 22 bp, Homo sapiens
gcagggcagtgtgtctgtgggg

SEQ ID NO: 10064841 - DNA, 22 bp, Homo sapiens
gcagggcaaacccaggtgttca

SEQ ID NO: 10064842 - DNA, 19 bp, Homo sapiens
gcatcagagcagaaggggt

SEQ ID NO: 10064843 - DNA, 22 bp, Homo sapiens
attccaaggtctttctagattg

SEQ ID NO: 10064844 - DNA, 19 bp, Homo sapiens
gcaggcagctggggtatcc

SEQ ID NO: 10064845 - DNA, 22 bp, Homo sapiens
gcagagaggatattattgtcca

SEQ ID NO: 10064846 - DNA, 22 bp, Homo sapiens
gcagagaggaatgaagccatcc

SEQ ID NO: 10064847 - DNA, 22 bp, Homo sapiens
gcaccagggagggtgtgcttca

SEQ ID NO: 10064848 - DNA, 22 bp, Homo sapiens
gcaccagggtgctgtgttctgg

SEQ ID NO: 10064849 - DNA, 22 bp, Homo sapiens
gcaccaggcagctgagcaggcc

SEQ ID NO: 10064850 - DNA, 22 bp, Homo sapiens
gcaccaggcttagagccccagg

SEQ ID NO: 10064851 - DNA, 22 bp, Homo sapiens
gcacacagctagattaccattc

SEQ ID NO: 10064852 - DNA, 22 bp, Homo sapiens
gatggcaggcaggtgagtagag

SEQ ID NO: 10064853 - DNA, 22 bp, Homo sapiens
gatggcagtcaaccaggtgagg

SEQ ID NO: 10064854 - DNA, 22 bp, Homo sapiens
gaagcggcatcaggaggctgcc

SEQ ID NO: 10064855 - DNA, 23 bp, Homo sapiens
gaagcagatgtctgagtaggcag

SEQ ID NO: 10064856 - DNA, 22 bp, Homo sapiens
gaaggaggtctgatacaatatg

SEQ ID NO: 10064857 - DNA, 22 bp, Homo sapiens
atgagcaggaagagcacaaaga

SEQ ID NO: 10064858 - DNA, 19 bp, Homo sapiens
atgagcaggcaagacaagc

SEQ ID NO: 10064859 - DNA, 22 bp, Homo sapiens
atgagcagtaggttcatggctg

SEQ ID NO: 10064860 - DNA, 22 bp, Homo sapiens
atgagcaggtttaagagaggcc

SEQ ID NO: 10064861 - DNA, 22 bp, Homo sapiens
atgagcagtttttaagtagcaa

SEQ ID NO: 10064862 - DNA, 19 bp, Homo sapiens
atgatggtcccattcacct

SEQ ID NO: 10064863 - DNA, 22 bp, Homo sapiens
atgatggtgaggttgagcacag

SEQ ID NO: 10064864 - DNA, 22 bp, Homo sapiens
atgatggtgggagatgacccag

SEQ ID NO: 10064865 - DNA, 18 bp, Homo sapiens
atgctgccctctgagggt

SEQ ID NO: 10064866 - DNA, 22 bp, Homo sapiens
atgagcagatgctcctgcctct

SEQ ID NO: 10064867 - DNA, 22 bp, Homo sapiens
atgagcagcattgctcctctta

SEQ ID NO: 10064868 - DNA, 23 bp, Homo sapiens
atgacactcctgtgcgcaccctg

SEQ ID NO: 10064869 - DNA, 22 bp, Homo sapiens
cttctcctctgagtcctgggag

SEQ ID NO: 10064870 - DNA, 22 bp, Homo sapiens
atgtgaggtagataggatgcag

SEQ ID NO: 10064871 - DNA, 22 bp, Homo sapiens
gaggagggcagttcctctttta

SEQ ID NO: 10064872 - DNA, 22 bp, Homo sapiens
gaggaggggacagtacttgtgc

SEQ ID NO: 10064873 - DNA, 22 bp, Homo sapiens
atgtatcaacaaattgtacagt

SEQ ID NO: 10064874 - DNA, 22 bp, Homo sapiens
gaggctcctccttacatttacc

SEQ ID NO: 10064875 - DNA, 22 bp, Homo sapiens
atgtatggaaagaagtggatgg

SEQ ID NO: 10064876 - DNA, 22 bp, Homo sapiens
atgggcagagctggtgggaggc

SEQ ID NO: 10064877 - DNA, 22 bp, Homo sapiens
atgggcagacagggagctcacg

SEQ ID NO: 10064878 - DNA, 22 bp, Homo sapiens
atgggagttttctctgatgctc

SEQ ID NO: 10064879 - DNA, 23 bp, Homo sapiens
gagctgagtgtagggagactagg

SEQ ID NO: 10064880 - DNA, 22 bp, Homo sapiens
gagcacagcgcagtttgtaatt

SEQ ID NO: 10064881 - DNA, 19 bp, Homo sapiens
gagcacagcggcatttggt

SEQ ID NO: 10064882 - DNA, 22 bp, Homo sapiens
atggcactaagagggagctgga

SEQ ID NO: 10064883 - DNA, 23 bp, Homo sapiens
gagaacagccacagagagctgtg

SEQ ID NO: 10064884 - DNA, 22 bp, Homo sapiens
accccaggtcatctgagagtcc

SEQ ID NO: 10064885 - DNA, 22 bp, Homo sapiens
accccaggcccagggaagaggc

SEQ ID NO: 10064886 - DNA, 22 bp, Homo sapiens
aaggtgggcagatcacaaggtc

SEQ ID NO: 10064887 - DNA, 22 bp, Homo sapiens
aagggctctgtgtgcctcccca

SEQ ID NO: 10064888 - DNA, 22 bp, Homo sapiens
aaggcatgaaagcgaaatgaga

SEQ ID NO: 10064889 - DNA, 22 bp, Homo sapiens
aaggctcttggagtgaatgcag

SEQ ID NO: 10064890 - DNA, 22 bp, Homo sapiens
aaggcttggaccagctacagtg

SEQ ID NO: 10064891 - DNA, 22 bp, Homo sapiens
aaggcttgttgtcacgctcttg

SEQ ID NO: 10064892 - DNA, 22 bp, Homo sapiens
aaggcttgttgagtatctactg

SEQ ID NO: 10064893 - DNA, 22 bp, Homo sapiens
acaggcaggttgagaaacattt

SEQ ID NO: 10064894 - DNA, 22 bp, Homo sapiens
acaggcagtgatttcctctggt

SEQ ID NO: 10064895 - DNA, 22 bp, Homo sapiens
acaggcagtgatttcctctggt

SEQ ID NO: 10064896 - DNA, 18 bp, Homo sapiens
aagccaggtcaagataag

SEQ ID NO: 10064897 - DNA, 22 bp, Homo sapiens
aagccaggctgcacttgctggg

SEQ ID NO: 10064898 - DNA, 22 bp, Homo sapiens
acaggcagttgaggtttgtgtg

SEQ ID NO: 10064899 - DNA, 22 bp, Homo sapiens
aaggcagtatctgtagagtgct

SEQ ID NO: 10064900 - DNA, 22 bp, Homo sapiens
aaggcagtaggtgtttcaaact

SEQ ID NO: 10064901 - DNA, 18 bp, Homo sapiens
aaggcagtatgattgcac

SEQ ID NO: 10064902 - DNA, 22 bp, Homo sapiens
aaggcagttaccgcaatggagg

SEQ ID NO: 10064903 - DNA, 22 bp, Homo sapiens
aaggcagtctggtttcaaagca

SEQ ID NO: 10064904 - DNA, 22 bp, Homo sapiens
aaggcacttttcctgagatgat

SEQ ID NO: 10064905 - DNA, 22 bp, Homo sapiens
actccaggttttctctcaagtt

SEQ ID NO: 10064906 - DNA, 20 bp, Homo sapiens
actccaggtggcatgaggac

SEQ ID NO: 10064907 - DNA, 22 bp, Homo sapiens
actccaggttttttcactgaag

SEQ ID NO: 10064908 - DNA, 22 bp, Homo sapiens
aagtcactgtgaaaggtgaagc

SEQ ID NO: 10064909 - DNA, 22 bp, Homo sapiens
aatcaagagctgactatatttt

SEQ ID NO: 10064910 - DNA, 18 bp, Homo sapiens
aatcaagagctggctgta

SEQ ID NO: 10064911 - DNA, 22 bp, Homo sapiens
agaagggaactcagagatgatt

SEQ ID NO: 10064912 - DNA, 22 bp, Homo sapiens
aatgaacaagaaagactttgag

SEQ ID NO: 10064913 - DNA, 22 bp, Homo sapiens
agatggggcagaatggagccat

SEQ ID NO: 10064914 - DNA, 22 bp, Homo sapiens
aatgttcagtagaataggaatg

SEQ ID NO: 10064915 - DNA, 22 bp, Homo sapiens
agacagcacttttgtatggggg

SEQ ID NO: 10064916 - DNA, 22 bp, Homo sapiens
agacagcagaaactagagcact

SEQ ID NO: 10064917 - DNA, 22 bp, Homo sapiens
agacagggccactcatcctcac

SEQ ID NO: 10064918 - DNA, 22 bp, Homo sapiens
agacagggagggagcgcggctg

SEQ ID NO: 10064919 - DNA, 22 bp, Homo sapiens
agacagggccactcatcctcac

SEQ ID NO: 10064920 - DNA, 22 bp, Homo sapiens
agccatctctgaaatcaaagct

SEQ ID NO: 10064921 - DNA, 22 bp, Homo sapiens
acagagcaggtccagaagtgcc

SEQ ID NO: 10064922 - DNA, 22 bp, Homo sapiens
acagagtcattcattgtccagt

SEQ ID NO: 10064923 - DNA, 22 bp, Homo sapiens
acagagcagtaagaacacagct

SEQ ID NO: 10064924 - DNA, 21 bp, Homo sapiens
acagagcataatggtgtggca

SEQ ID NO: 10064925 - DNA, 22 bp, Homo sapiens
acagagcataatgtctagcaca

SEQ ID NO: 10064926 - DNA, 22 bp, Homo sapiens
acagagcatgctcagtgtgtga

SEQ ID NO: 10064927 - DNA, 20 bp, Homo sapiens
agcctgccagctggcccaga

SEQ ID NO: 10064928 - DNA, 17 bp, Homo sapiens
agcctgccccatgctgc

SEQ ID NO: 10064929 - DNA, 22 bp, Homo sapiens
acagcaaaagacaagaacttaa

SEQ ID NO: 10064930 - DNA, 22 bp, Homo sapiens
acagcaaaggacgaacactctg

SEQ ID NO: 10064931 - DNA, 22 bp, Homo sapiens
acagcaagacccctagcatggt

SEQ ID NO: 10064932 - DNA, 21 bp, Homo sapiens
acagcaagccttcacatgagt

SEQ ID NO: 10064933 - DNA, 22 bp, Homo sapiens
agctaggggaccaaggtggccc

SEQ ID NO: 10064934 - DNA, 20 bp, Homo sapiens
agctcctttgtgtccaggat

SEQ ID NO: 10064935 - DNA, 22 bp, Homo sapiens
agcagcagtgtgtggtcatgtt

SEQ ID NO: 10064936 - DNA, 22 bp, Homo sapiens
acagaaattctgggacagaaaa

SEQ ID NO: 10064937 - DNA, 23 bp, Homo sapiens
agcagggccagaatacttgctgt

SEQ ID NO: 10064938 - DNA, 22 bp, Homo sapiens
aaagctggttattctgaggcag

SEQ ID NO: 10064939 - DNA, 22 bp, Homo sapiens
aaagctggcttttacaggggct

SEQ ID NO: 10064940 - DNA, 22 bp, Homo sapiens
aaagccatctgtattaagtgaa

SEQ ID NO: 10064941 - DNA, 22 bp, Homo sapiens
aaagccataagcctaatactaa

SEQ ID NO: 10064942 - DNA, 21 bp, Homo sapiens
aaagaacaggcagatgttctt

SEQ ID NO: 10064943 - DNA, 22 bp, Homo sapiens
aaactagagcatgtgagtggga

SEQ ID NO: 10064944 - DNA, 22 bp, Homo sapiens
aaacagagagatgtatgtggag

SEQ ID NO: 10064945 - DNA, 22 bp, Homo sapiens
aaacacaggtactgcagaagtg

SEQ ID NO: 10064946 - DNA, 22 bp, Homo sapiens
aaaagagcaaacatgtaatagt

SEQ ID NO: 10064947 - DNA, 22 bp, Homo sapiens
aaagacattagcttagatgtca

SEQ ID NO: 10064948 - DNA, 21 bp, Homo sapiens
acactgcaggtgaagtgcact

SEQ ID NO: 10064949 - DNA, 22 bp, Homo sapiens
acactgcatttcaacaaggccc

SEQ ID NO: 10064950 - DNA, 22 bp, Homo sapiens
aagcacagaaaaggagcatgga

SEQ ID NO: 10064951 - DNA, 22 bp, Homo sapiens
aagcacaggatcttgaggagcg

SEQ ID NO: 10064952 - DNA, 22 bp, Homo sapiens
aagccaggaagagagccttcac

SEQ ID NO: 10064953 - DNA, 22 bp, Homo sapiens
aagccaggaatggagtcttcgc

SEQ ID NO: 10064954 - DNA, 22 bp, Homo sapiens
aagccaggaagggagctgtccc

SEQ ID NO: 10064955 - DNA, 22 bp, Homo sapiens
acagcagcttgtctgttcttta

SEQ ID NO: 10064956 - DNA, 19 bp, Homo sapiens
aagcagccctggcaagagc

SEQ ID NO: 10064957 - DNA, 17 bp, Homo sapiens
acagaggttatacagac

SEQ ID NO: 10064958 - DNA, 18 bp, Homo sapiens
acagacaaaatggaaatg

SEQ ID NO: 10064959 - DNA, 19 bp, Homo sapiens
aagagcagggaaagaattg

SEQ ID NO: 10064960 - DNA, 22 bp, Homo sapiens
aagagctggagctgctacagga

SEQ ID NO: 10064961 - DNA, 22 bp, Homo sapiens
aagagagaacacagcttgggca

SEQ ID NO: 10064962 - DNA, 20 bp, Homo sapiens
aacagggggctgcagagggc

SEQ ID NO: 10064963 - DNA, 22 bp, Homo sapiens
aacaggggattagatagcaggc

SEQ ID NO: 10064964 - DNA, 22 bp, Homo sapiens
aacaggggtgggtgctactgga

SEQ ID NO: 10064965 - DNA, 22 bp, Homo sapiens
aacaggacactgggatggctac

SEQ ID NO: 10064966 - DNA, 22 bp, Homo sapiens
aacaggaccccgcgtggtgtct

SEQ ID NO: 10064967 - DNA, 22 bp, Homo sapiens
aacagcagggatgacatggcca

SEQ ID NO: 10064968 - DNA, 22 bp, Homo sapiens
aacagcagggaaattccaagtc

SEQ ID NO: 10064969 - DNA, 22 bp, Homo sapiens
aacagcaggtcctggcatgggt

SEQ ID NO: 10064970 - DNA, 22 bp, Homo sapiens
aacagagcttgggtcatctcat

SEQ ID NO: 10064971 - DNA, 22 bp, Homo sapiens
aacagagctggtgactccaggt

SEQ ID NO: 10064972 - DNA, 22 bp, Homo sapiens
aacagagctctgctctcagatt

SEQ ID NO: 10064973 - DNA, 22 bp, Homo sapiens
aacagagctgaccagtgagggc

SEQ ID NO: 10064974 - DNA, 17 bp, Homo sapiens
aagtccagagttgagca

SEQ ID NO: 10064975 - DNA, 22 bp, Homo sapiens
aacactctacgtgcagctccta

SEQ ID NO: 10064976 - DNA, 22 bp, Homo sapiens
aaggtcactgatcagttgagta

SEQ ID NO: 10064977 - DNA, 23 bp, Homo sapiens
agaggctcagcgtccacctctac

SEQ ID NO: 10064978 - DNA, 22 bp, Homo sapiens
agaggctcagaggcctggtcct

SEQ ID NO: 10064979 - DNA, 22 bp, Homo sapiens
agaggctccaccttctctgtcc

SEQ ID NO: 10064980 - DNA, 22 bp, Homo sapiens
agaggctcctagccactggctt

SEQ ID NO: 10064981 - DNA, 22 bp, Homo sapiens
agaggagcctcagtttgcagcc

SEQ ID NO: 10064982 - DNA, 22 bp, Homo sapiens
agagtgggtgatctctgttgtc

SEQ ID NO: 10064983 - DNA, 22 bp, Homo sapiens
atttcacagctgtcagtgttac

SEQ ID NO: 10064984 - DNA, 22 bp, Homo sapiens
agagccagcaactctagccctg

SEQ ID NO: 10064985 - DNA, 22 bp, Homo sapiens
agagccagcaagtgaatagtga

SEQ ID NO: 10064986 - DNA, 22 bp, Homo sapiens
agagccagagacctgggttcac

SEQ ID NO: 10064987 - DNA, 22 bp, Homo sapiens
agagccactgggagacagagca

SEQ ID NO: 10064988 - DNA, 19 bp, Homo sapiens
agagccagacagcatagga

SEQ ID NO: 10064989 - DNA, 22 bp, Homo sapiens
agagccacagtggataggagcc

SEQ ID NO: 10064990 - DNA, 22 bp, Homo sapiens
agagcagtgctgaagagtaggg

SEQ ID NO: 10064991 - DNA, 17 bp, Homo sapiens
agagcatgtgtaggagc

SEQ ID NO: 10064992 - DNA, 18 bp, Homo sapiens
agagcagcggcatcacac

SEQ ID NO: 10064993 - DNA, 22 bp, Homo sapiens
agagcagcctgtgatgatgcac

SEQ ID NO: 10064994 - DNA, 22 bp, Homo sapiens
agagcagcctcagctccctgtg

SEQ ID NO: 10064995 - DNA, 22 bp, Homo sapiens
agagacctgagatcctcgacat

SEQ ID NO: 10064996 - DNA, 22 bp, Homo sapiens
agacagctgggaaatggagtgt

SEQ ID NO: 10064997 - DNA, 22 bp, Homo sapiens
agacagcatttctagcaccagg

SEQ ID NO: 10064998 - DNA, 18 bp, Homo sapiens
agacagctgaaaggaaaa

SEQ ID NO: 10064999 - DNA, 22 bp, Homo sapiens
agacagctatcaacaactttct

SEQ ID NO: 10065000 - DNA, 22 bp, Homo sapiens
agacagctaataaatgagtgtg

SEQ ID NO: 10065001 - DNA, 22 bp, Homo sapiens
agacagcagcagaggggctccc

SEQ ID NO: 10065002 - DNA, 22 bp, Homo sapiens
agaagtggtctgtcttccagat

SEQ ID NO: 10065003 - DNA, 17 bp, Homo sapiens
caagagagatgactgga

SEQ ID NO: 10065004 - DNA, 22 bp, Homo sapiens
caagagccataattttgagagt

SEQ ID NO: 10065005 - DNA, 22 bp, Homo sapiens
agcagctgagccccagctgtga

SEQ ID NO: 10065006 - DNA, 22 bp, Homo sapiens
agcagctgatcaaagcacttat

SEQ ID NO: 10065007 - DNA, 22 bp, Homo sapiens
agcagctgcagggagggtctgc

SEQ ID NO: 10065008 - DNA, 22 bp, Homo sapiens
agcaggcaaggtccgtgcctcg

SEQ ID NO: 10065009 - DNA, 22 bp, Homo sapiens
agcaggcacgctccctgcgcga

SEQ ID NO: 10065010 - DNA, 22 bp, Homo sapiens
agcaggagcatttccatgattc

SEQ ID NO: 10065011 - DNA, 22 bp, Homo sapiens
agcaggctccaggctggccatc

SEQ ID NO: 10065012 - DNA, 22 bp, Homo sapiens
cactgcctgtgagctgtgtgcc

SEQ ID NO: 10065013 - DNA, 22 bp, Homo sapiens
agcaggggtctctgctaatgaa

SEQ ID NO: 10065014 - DNA, 23 bp, Homo sapiens
agcaggctgcttctccacagctg

SEQ ID NO: 10065015 - DNA, 22 bp, Homo sapiens
agcaggggcagggttttgtgct

SEQ ID NO: 10065016 - DNA, 22 bp, Homo sapiens
agcagggggagttagactagat

SEQ ID NO: 10065017 - DNA, 22 bp, Homo sapiens
agcaggggtaacagaaggaaag

SEQ ID NO: 10065018 - DNA, 22 bp, Homo sapiens
cagctcaggctctccatgctcc

SEQ ID NO: 10065019 - DNA, 22 bp, Homo sapiens
agctcagagataatcaagagac

SEQ ID NO: 10065020 - DNA, 22 bp, Homo sapiens
agctcagcactgtcagcactcc

SEQ ID NO: 10065021 - DNA, 22 bp, Homo sapiens
cagctcagtttcaataccaggt

SEQ ID NO: 10065022 - DNA, 22 bp, Homo sapiens
agctcagagataatcaagagac

SEQ ID NO: 10065023 - DNA, 22 bp, Homo sapiens
cagcagtgtggaagctgagggg

SEQ ID NO: 10065024 - DNA, 22 bp, Homo sapiens
cagcagctcagtctctcagtag

SEQ ID NO: 10065025 - DNA, 22 bp, Homo sapiens
agccaccttcacatggtctatc

SEQ ID NO: 10065026 - DNA, 22 bp, Homo sapiens
cagaatggcttttatggctcag

SEQ ID NO: 10065027 - DNA, 22 bp, Homo sapiens
cagaggcagtggggttgctcct

SEQ ID NO: 10065028 - DNA, 22 bp, Homo sapiens
agcccaggctggagtgcagtgg

SEQ ID NO: 10065029 - DNA, 22 bp, Homo sapiens
agcccagggaaccaggaagtgg

SEQ ID NO: 10065030 - DNA, 18 bp, Homo sapiens
agcccaggcatcgtctgc

SEQ ID NO: 10065031 - DNA, 20 bp, Homo sapiens
agcccaggcctgtgtgagtc

SEQ ID NO: 10065032 - DNA, 22 bp, Homo sapiens
agcccagaaatgaaaggatgat

SEQ ID NO: 10065033 - DNA, 22 bp, Homo sapiens
agcccagaggggtttgaggact

SEQ ID NO: 10065034 - DNA, 22 bp, Homo sapiens
agcccagataaagtacaaccat

SEQ ID NO: 10065035 - DNA, 22 bp, Homo sapiens
agcccagatggtagccctagaa

SEQ ID NO: 10065036 - DNA, 22 bp, Homo sapiens
aggagcaaatgatgagacagca

SEQ ID NO: 10065037 - DNA, 22 bp, Homo sapiens
acagtctctccacactgcaggg

SEQ ID NO: 10065038 - DNA, 22 bp, Homo sapiens
acatagcatgtttggacacatg

SEQ ID NO: 10065039 - DNA, 22 bp, Homo sapiens
aggcactgggggatgagcaagg

SEQ ID NO: 10065040 - DNA, 22 bp, Homo sapiens
acagggagatgggtgaaagcgg

SEQ ID NO: 10065041 - DNA, 22 bp, Homo sapiens
acagggacctgtgagctccata

SEQ ID NO: 10065042 - DNA, 22 bp, Homo sapiens
acaggcagggacctcttgagtt

SEQ ID NO: 10065043 - DNA, 22 bp, Homo sapiens
acaggcagggaccttggctaag

SEQ ID NO: 10065044 - DNA, 22 bp, Homo sapiens
acaggcagattaagggtaggca

SEQ ID NO: 10065045 - DNA, 22 bp, Homo sapiens
acaggcagcaaaatcagcctca

SEQ ID NO: 10065046 - DNA, 22 bp, Homo sapiens
acaggcagatgttttagttgta

SEQ ID NO: 10065047 - DNA, 22 bp, Homo sapiens
acaggcagattaagggtaggca

SEQ ID NO: 10065048 - DNA, 22 bp, Homo sapiens
acaggcagatgttttagttgta

SEQ ID NO: 10065049 - DNA, 22 bp, Homo sapiens
acaggcagcgtcattgctgctc

SEQ ID NO: 10065050 - DNA, 22 bp, Homo sapiens
acaggcaggagctccccattcc

SEQ ID NO: 10065051 - DNA, 22 bp, Homo sapiens
acaggcagcactaatctctggt

SEQ ID NO: 10065052 - DNA, 22 bp, Homo sapiens
agctggaggggccagcaggtgt

SEQ ID NO: 10065053 - DNA, 22 bp, Homo sapiens
acaggagggacaccttcctgct

SEQ ID NO: 10065054 - DNA, 23 bp, Homo sapiens
acaggaggggacaggtggccgtg

SEQ ID NO: 10065055 - DNA, 22 bp, Homo sapiens
acaggaggggcatgaaagacgg

SEQ ID NO: 10065056 - DNA, 22 bp, Homo sapiens
acaggcagagtcaggttgggtt

SEQ ID NO: 10065057 - DNA, 17 bp, Homo sapiens
acaggcagatcacctga

SEQ ID NO: 10065058 - DNA, 22 bp, Homo sapiens
agctggtgtcctcctggagctg

SEQ ID NO: 10065059 - DNA, 18 bp, Homo sapiens
agctggtggggagacagc

SEQ ID NO: 10065060 - DNA, 21 bp, Homo sapiens
acatcagagttgtgaaggtag

SEQ ID NO: 10065061 - DNA, 22 bp, Homo sapiens
acatcagattatgctttgctta

SEQ ID NO: 10065062 - DNA, 23 bp, Homo sapiens
acatcagagttagttcaatcagg

SEQ ID NO: 10065063 - DNA, 22 bp, Homo sapiens
acatcagagggctcacatgatc

SEQ ID NO: 10065064 - DNA, 22 bp, Homo sapiens
acatcagacaattaattattaa

SEQ ID NO: 10065065 - DNA, 22 bp, Homo sapiens
accagcagctgccagagtggag

SEQ ID NO: 10065066 - DNA, 22 bp, Homo sapiens
aggggcctggacatggacgcgc

SEQ ID NO: 10065067 - DNA, 19 bp, Homo sapiens
aggtggccatgtccagcct

SEQ ID NO: 10065068 - DNA, 22 bp, Homo sapiens
accctccccaagaggtcgtgcc

SEQ ID NO: 10065069 - DNA, 22 bp, Homo sapiens
accctcccatttccatgtagca

SEQ ID NO: 10065070 - DNA, 22 bp, Homo sapiens
accctccccaagaggtcgtgcc

SEQ ID NO: 10065071 - DNA, 22 bp, Homo sapiens
accctcccatttccatgtagca

SEQ ID NO: 10065072 - DNA, 22 bp, Homo sapiens
acctcccttgctaaagactgtg

SEQ ID NO: 10065073 - DNA, 22 bp, Homo sapiens
actaggggctcaggcccaggga

SEQ ID NO: 10065074 - DNA, 22 bp, Homo sapiens
agtcaaagatgaccgagttcct

SEQ ID NO: 10065075 - DNA, 22 bp, Homo sapiens
acgcttctggttctggctttag

SEQ ID NO: 10065076 - DNA, 22 bp, Homo sapiens
agtggcagtagatgagctggtt

SEQ ID NO: 10065077 - DNA, 22 bp, Homo sapiens
actggaaaaccactgaaatgag

SEQ ID NO: 10065078 - DNA, 22 bp, Homo sapiens
acttcttgatgaaaatggtact

SEQ ID NO: 10065079 - DNA, 22 bp, Homo sapiens
acttcttgggaccctggcaccg

SEQ ID NO: 10065080 - DNA, 22 bp, Homo sapiens
agaacaggaggaagccagctcc

SEQ ID NO: 10065081 - DNA, 22 bp, Homo sapiens
agaacaggcagttggttggatt

SEQ ID NO: 10065082 - DNA, 22 bp, Homo sapiens
agaacagcaggaaggccaggta

SEQ ID NO: 10065083 - DNA, 22 bp, Homo sapiens
agaacagccaataaaagagggg

SEQ ID NO: 10065084 - DNA, 22 bp, Homo sapiens
tcagaacagaagaaggaacacg

SEQ ID NO: 10065085 - DNA, 22 bp, Homo sapiens
tcagaacagaagctggctataa

SEQ ID NO: 10065086 - DNA, 22 bp, Homo sapiens
tcagaacaattcctttataaca

SEQ ID NO: 10065087 - DNA, 22 bp, Homo sapiens
tcagaacagcacagggtgattt

SEQ ID NO: 10065088 - DNA, 22 bp, Homo sapiens
tcagaacagcagggtgtggctg

SEQ ID NO: 10065089 - DNA, 22 bp, Homo sapiens
tcactgctatattggatactga

SEQ ID NO: 10065090 - DNA, 22 bp, Homo sapiens
tcactgctctccaatgtggagt

SEQ ID NO: 10065091 - DNA, 22 bp, Homo sapiens
tcaggacatttgtcagcaggag

SEQ ID NO: 10065092 - DNA, 22 bp, Homo sapiens
tcaggacagaaggctgccaggg

SEQ ID NO: 10065093 - DNA, 22 bp, Homo sapiens
tcaggacacttggcacaaggtc

SEQ ID NO: 10065094 - DNA, 22 bp, Homo sapiens
tcagaattttctggaatggagc

SEQ ID NO: 10065095 - DNA, 22 bp, Homo sapiens
tcagaattttaaaccaaggaaa

SEQ ID NO: 10065096 - DNA, 22 bp, Homo sapiens
tcagaatttaaaatgtgtagat

SEQ ID NO: 10065097 - DNA, 22 bp, Homo sapiens
tcagaatttgattcctgggata

SEQ ID NO: 10065098 - DNA, 22 bp, Homo sapiens
tcagaattgtctggggaatgtt

SEQ ID NO: 10065099 - DNA, 22 bp, Homo sapiens
tcagaattgcagggagggcagg

SEQ ID NO: 10065100 - DNA, 22 bp, Homo sapiens
tcagaattctacaatagatcag

SEQ ID NO: 10065101 - DNA, 22 bp, Homo sapiens
tcagaattctgaagggcacaaa

SEQ ID NO: 10065102 - DNA, 22 bp, Homo sapiens
tcagaattatgtaggcctggtt

SEQ ID NO: 10065103 - DNA, 22 bp, Homo sapiens
tcagaattcagagggagtgggg

SEQ ID NO: 10065104 - DNA, 22 bp, Homo sapiens
tcagaattacacagggccttga

SEQ ID NO: 10065105 - DNA, 21 bp, Homo sapiens
tcagaattacccctggatctg

SEQ ID NO: 10065106 - DNA, 22 bp, Homo sapiens
tcagggcatactcttcaaggtc

SEQ ID NO: 10065107 - DNA, 22 bp, Homo sapiens
tcagggcatcatcatgaatata

SEQ ID NO: 10065108 - DNA, 22 bp, Homo sapiens
tcagggcatccattgcctgttg

SEQ ID NO: 10065109 - DNA, 22 bp, Homo sapiens
tcagggcatctcttaagtggtg

SEQ ID NO: 10065110 - DNA, 19 bp, Homo sapiens
tcagggcagtccggtcccc

SEQ ID NO: 10065111 - DNA, 21 bp, Homo sapiens
tcagggcagtgggaggttcct

SEQ ID NO: 10065112 - DNA, 22 bp, Homo sapiens
tcagggcaggttaacttgggtg

SEQ ID NO: 10065113 - DNA, 22 bp, Homo sapiens
tcagggcaggcgagcagctgct

SEQ ID NO: 10065114 - DNA, 22 bp, Homo sapiens
tcagggcaggacagtgtaggcc

SEQ ID NO: 10065115 - DNA, 22 bp, Homo sapiens
tccaaatagctggatgatggtg

SEQ ID NO: 10065116 - DNA, 21 bp, Homo sapiens
tccaaaggagactgagtgtgt

SEQ ID NO: 10065117 - DNA, 17 bp, Homo sapiens
tcatttgggcctcacaa

SEQ ID NO: 10065118 - DNA, 22 bp, Homo sapiens
tcctcttcagagggacctcggg

SEQ ID NO: 10065119 - DNA, 22 bp, Homo sapiens
tcctctggggcgtggtcctgga

SEQ ID NO: 10065120 - DNA, 22 bp, Homo sapiens
tcctctggggtcagggcactac

SEQ ID NO: 10065121 - DNA, 19 bp, Homo sapiens
tcctctggtaccacccttg

SEQ ID NO: 10065122 - DNA, 22 bp, Homo sapiens
tcccaggctgggggcctgaagt

SEQ ID NO: 10065123 - DNA, 22 bp, Homo sapiens
tcccaggctggggccaggtgac

SEQ ID NO: 10065124 - DNA, 22 bp, Homo sapiens
tcccaggctaggcctctgcgtt

SEQ ID NO: 10065125 - DNA, 20 bp, Homo sapiens
tcccaggctgggctccagct

SEQ ID NO: 10065126 - DNA, 22 bp, Homo sapiens
tccctccccacttctgagcttt

SEQ ID NO: 10065127 - DNA, 20 bp, Homo sapiens
tccctccctccagctctggg

SEQ ID NO: 10065128 - DNA, 22 bp, Homo sapiens
tccctctggtctggacgccata

SEQ ID NO: 10065129 - DNA, 18 bp, Homo sapiens
tccctccctgctgtggcc

SEQ ID NO: 10065130 - DNA, 19 bp, Homo sapiens
tccctccctgtaatctcac

SEQ ID NO: 10065131 - DNA, 22 bp, Homo sapiens
tcctcagatataaatgagggtg

SEQ ID NO: 10065132 - DNA, 22 bp, Homo sapiens
tcctcagaatggatggcagggg

SEQ ID NO: 10065133 - DNA, 19 bp, Homo sapiens
tcctcaggggctcacagac

SEQ ID NO: 10065134 - DNA, 21 bp, Homo sapiens
tcctcagggccccagagcact

SEQ ID NO: 10065135 - DNA, 22 bp, Homo sapiens
tcctcagggggccaacccagcc

SEQ ID NO: 10065136 - DNA, 22 bp, Homo sapiens
tcctcacaagcatcctgtctca

SEQ ID NO: 10065137 - DNA, 22 bp, Homo sapiens
tcctcacactatagatgaggat

SEQ ID NO: 10065138 - DNA, 22 bp, Homo sapiens
tcctcacagagtggcaggcaat

SEQ ID NO: 10065139 - DNA, 22 bp, Homo sapiens
tcctcacagcatgaccaggcag

SEQ ID NO: 10065140 - DNA, 22 bp, Homo sapiens
tcctcacaagcaagcacaggta

SEQ ID NO: 10065141 - DNA, 22 bp, Homo sapiens
tcctcagaatcacctggcagct

SEQ ID NO: 10065142 - DNA, 22 bp, Homo sapiens
tccctggcactgctgtgattag

SEQ ID NO: 10065143 - DNA, 22 bp, Homo sapiens
tccagggctgggttggctcagc

SEQ ID NO: 10065144 - DNA, 22 bp, Homo sapiens
tccagggctgacttgggagagg

SEQ ID NO: 10065145 - DNA, 18 bp, Homo sapiens
tccagggcttcctcctct

SEQ ID NO: 10065146 - DNA, 22 bp, Homo sapiens
tccagggcttgacagggtgcct

SEQ ID NO: 10065147 - DNA, 21 bp, Homo sapiens
tccagggctttgattctctca

SEQ ID NO: 10065148 - DNA, 19 bp, Homo sapiens
tccagggctttatggcttt

SEQ ID NO: 10065149 - DNA, 22 bp, Homo sapiens
tccagggcttggctgggacggt

SEQ ID NO: 10065150 - DNA, 22 bp, Homo sapiens
tcccagcctggaccctgccagt

SEQ ID NO: 10065151 - DNA, 22 bp, Homo sapiens
tcccagccttatctcccctggc

SEQ ID NO: 10065152 - DNA, 22 bp, Homo sapiens
tcccagccggtgcctgggtccc

SEQ ID NO: 10065153 - DNA, 22 bp, Homo sapiens
tcccagaggctccagtctctat

SEQ ID NO: 10065154 - DNA, 22 bp, Homo sapiens
tcccagagatttcctctccttc

SEQ ID NO: 10065155 - DNA, 22 bp, Homo sapiens
tacagagagtacagcatccaca

SEQ ID NO: 10065156 - DNA, 22 bp, Homo sapiens
taccaaagttttctgagtgata

SEQ ID NO: 10065157 - DNA, 22 bp, Homo sapiens
tacatgcatgtcacagaatgaa

SEQ ID NO: 10065158 - DNA, 22 bp, Homo sapiens
gttcttgccagcatcctcaggt

SEQ ID NO: 10065159 - DNA, 22 bp, Homo sapiens
gttgaatgaatggagaattaat

SEQ ID NO: 10065160 - DNA, 22 bp, Homo sapiens
taacagcatttgaatgagtaac

SEQ ID NO: 10065161 - DNA, 22 bp, Homo sapiens
tagggcagagtccaggatgggc

SEQ ID NO: 10065162 - DNA, 22 bp, Homo sapiens
tagcaaagagaaaaattatgct

SEQ ID NO: 10065163 - DNA, 22 bp, Homo sapiens
tagcaaagctccgtagttattt

SEQ ID NO: 10065164 - DNA, 22 bp, Homo sapiens
tagctgacagatacaatcagat

SEQ ID NO: 10065165 - DNA, 22 bp, Homo sapiens
tagactagaggatcagcaaggg

SEQ ID NO: 10065166 - DNA, 22 bp, Homo sapiens
tagagagagatatatacacaca

SEQ ID NO: 10065167 - DNA, 20 bp, Homo sapiens
tagagagaggatattaaagt

SEQ ID NO: 10065168 - DNA, 22 bp, Homo sapiens
tagagagagctgtggtggctct

SEQ ID NO: 10065169 - DNA, 20 bp, Homo sapiens
tagagagatatgggggttcc

SEQ ID NO: 10065170 - DNA, 22 bp, Homo sapiens
tatcagaacacatgttttgcag

SEQ ID NO: 10065171 - DNA, 22 bp, Homo sapiens
tatcagaacacagccacagcca

SEQ ID NO: 10065172 - DNA, 22 bp, Homo sapiens
tatcagaaatgccttaaattgg

SEQ ID NO: 10065173 - DNA, 22 bp, Homo sapiens
tatcagaaatcaacacacagtg

SEQ ID NO: 10065174 - DNA, 22 bp, Homo sapiens
tatcagaaagatattactgggg

SEQ ID NO: 10065175 - DNA, 22 bp, Homo sapiens
tatcagaaactctggggcaggg

SEQ ID NO: 10065176 - DNA, 22 bp, Homo sapiens
tatcagaagacttacagtatcg

SEQ ID NO: 10065177 - DNA, 21 bp, Homo sapiens
tatcagaagagaaagaatgat

SEQ ID NO: 10065178 - DNA, 22 bp, Homo sapiens
tatcagaaggaagtgcctttaa

SEQ ID NO: 10065179 - DNA, 22 bp, Homo sapiens
tatcagaaggcacatggagtct

SEQ ID NO: 10065180 - DNA, 22 bp, Homo sapiens
tatcagaatgcagccatgtgca

SEQ ID NO: 10065181 - DNA, 17 bp, Homo sapiens
tatcagaatgtgtttac

SEQ ID NO: 10065182 - DNA, 22 bp, Homo sapiens
tcaaaggctgcttgtcttctgg

SEQ ID NO: 10065183 - DNA, 22 bp, Homo sapiens
tcaaagatgatgctgaagttat

SEQ ID NO: 10065184 - DNA, 18 bp, Homo sapiens
gtgctgatgagtggtttt

SEQ ID NO: 10065185 - DNA, 22 bp, Homo sapiens
gtgaggcaagggcatactaggc

SEQ ID NO: 10065186 - DNA, 22 bp, Homo sapiens
gtctccagaagcctagacagcc

SEQ ID NO: 10065187 - DNA, 22 bp, Homo sapiens
gtctccagaattcttgggaggg

SEQ ID NO: 10065188 - DNA, 22 bp, Homo sapiens
gtctcccaatccgggacagcct

SEQ ID NO: 10065189 - DNA, 22 bp, Homo sapiens
gtctccagttacagcagccagg

SEQ ID NO: 10065190 - DNA, 22 bp, Homo sapiens
gtgagcagggcaggactgggga

SEQ ID NO: 10065191 - DNA, 22 bp, Homo sapiens
gtgagccgagtatagttcatag

SEQ ID NO: 10065192 - DNA, 22 bp, Homo sapiens
gtgagcagttgtataaagactt

SEQ ID NO: 10065193 - DNA, 22 bp, Homo sapiens
gtcactcttccccatagcctac

SEQ ID NO: 10065194 - DNA, 22 bp, Homo sapiens
gtcagaatttacttaatagcca

SEQ ID NO: 10065195 - DNA, 22 bp, Homo sapiens
gtccaggctgcccagggtcctg

SEQ ID NO: 10065196 - DNA, 22 bp, Homo sapiens
gtccaggcacctcccttgtgct

SEQ ID NO: 10065197 - DNA, 22 bp, Homo sapiens
gtccaggccatggtggacacag

SEQ ID NO: 10065198 - DNA, 19 bp, Homo sapiens
gtccaggcattgggttggt

SEQ ID NO: 10065199 - DNA, 22 bp, Homo sapiens
gtccaggaatcaaaagatggaa

SEQ ID NO: 10065200 - DNA, 22 bp, Homo sapiens
gtccaggctcaaaaggttgtta

SEQ ID NO: 10065201 - DNA, 22 bp, Homo sapiens
gtccaggctaagtcccttctgc

SEQ ID NO: 10065202 - DNA, 22 bp, Homo sapiens
gtccaggctgacccctagagga

SEQ ID NO: 10065203 - DNA, 22 bp, Homo sapiens
gtccaggcctgcctctgaggag

SEQ ID NO: 10065204 - DNA, 22 bp, Homo sapiens
gtccaggccccagggattcttg

SEQ ID NO: 10065205 - DNA, 22 bp, Homo sapiens
gtcctgggaactggacagctaa

SEQ ID NO: 10065206 - DNA, 22 bp, Homo sapiens
ggggaggctgatgtgggcaaag

SEQ ID NO: 10065207 - DNA, 22 bp, Homo sapiens
ggggatctaggcttatgagggc

SEQ ID NO: 10065208 - DNA, 22 bp, Homo sapiens
ggggaggcaagatgaagtgagg

SEQ ID NO: 10065209 - DNA, 22 bp, Homo sapiens
ggggaggccagtggaccgtccc

SEQ ID NO: 10065210 - DNA, 22 bp, Homo sapiens
ggtgagcagctgtctgtatgga

SEQ ID NO: 10065211 - DNA, 22 bp, Homo sapiens
ggtgagcactgccctgggtctc

SEQ ID NO: 10065212 - DNA, 22 bp, Homo sapiens
ggtgagcaaagcttcatctgta

SEQ ID NO: 10065213 - DNA, 22 bp, Homo sapiens
gggttgaggcggatgtcggcgg

SEQ ID NO: 10065214 - DNA, 22 bp, Homo sapiens
ggtggagctgtgagtagaatct

SEQ ID NO: 10065215 - DNA, 18 bp, Homo sapiens
ggcagggaaaagataggg

SEQ ID NO: 10065216 - DNA, 22 bp, Homo sapiens
ggcagtgagctggagggaagga

SEQ ID NO: 10065217 - DNA, 22 bp, Homo sapiens
ggcagatggagaagcagcaggt

SEQ ID NO: 10065218 - DNA, 22 bp, Homo sapiens
ggcagatgttgcagtgagcaga

SEQ ID NO: 10065219 - DNA, 23 bp, Homo sapiens
ggaggcacttaggcagagcagag

SEQ ID NO: 10065220 - DNA, 22 bp, Homo sapiens
ggcctctctgagagcagacgtt

SEQ ID NO: 10065221 - DNA, 22 bp, Homo sapiens
ggctcactgcaacttccgcctc

SEQ ID NO: 10065222 - DNA, 22 bp, Homo sapiens
ggctcactgcaacctctgcctc

SEQ ID NO: 10065223 - DNA, 22 bp, Homo sapiens
ggctcactgcaaactgtgcctc

SEQ ID NO: 10065224 - DNA, 22 bp, Homo sapiens
ggctcagacctcccagctccag

SEQ ID NO: 10065225 - DNA, 22 bp, Homo sapiens
ggctcagaggccagcaggtaga

SEQ ID NO: 10065226 - DNA, 22 bp, Homo sapiens
ggctcactttggggtcagctgg

SEQ ID NO: 10065227 - DNA, 21 bp, Homo sapiens
ggccagcagcgtccactgtgg

SEQ ID NO: 10065228 - DNA, 22 bp, Homo sapiens
ggccagcaggccctgtgatcct

SEQ ID NO: 10065229 - DNA, 22 bp, Homo sapiens
ggccagcagtcacagggtcaga

SEQ ID NO: 10065230 - DNA, 22 bp, Homo sapiens
ggccagcagtatatagctaatt

SEQ ID NO: 10065231 - DNA, 22 bp, Homo sapiens
ggccagcatatagagtgaagta

SEQ ID NO: 10065232 - DNA, 22 bp, Homo sapiens
ggccagcatggcaagaccaact

SEQ ID NO: 10065233 - DNA, 22 bp, Homo sapiens
ggcccaggctggagtgcagtgg

SEQ ID NO: 10065234 - DNA, 22 bp, Homo sapiens
ggccagcagacctcagggactc

SEQ ID NO: 10065235 - DNA, 19 bp, Homo sapiens
ggccagcacagggctctgt

SEQ ID NO: 10065236 - DNA, 22 bp, Homo sapiens
ggctggaggtagaagaacactt

SEQ ID NO: 10065237 - DNA, 17 bp, Homo sapiens
ggctggaggggacccgg

SEQ ID NO: 10065238 - DNA, 17 bp, Homo sapiens
ggctggagcagctcccc

SEQ ID NO: 10065239 - DNA, 22 bp, Homo sapiens
ggctggagatatgtctggaaca

SEQ ID NO: 10065240 - DNA, 22 bp, Homo sapiens
ggctggagatatgtctggaaca

SEQ ID NO: 10065241 - DNA, 22 bp, Homo sapiens
gggctcagagcatttgggttgg

SEQ ID NO: 10065242 - DNA, 22 bp, Homo sapiens
gggctcagaggagtggcctggg

SEQ ID NO: 10065243 - DNA, 16 bp, Homo sapiens
gggctcagatctttga

SEQ ID NO: 10065244 - DNA, 23 bp, Homo sapiens
gggctcagatttcattctgtgcc

SEQ ID NO: 10065245 - DNA, 22 bp, Homo sapiens
gggctcagcctcctcacttcga

SEQ ID NO: 10065246 - DNA, 22 bp, Homo sapiens
gggctcagccccattgaaccag

SEQ ID NO: 10065247 - DNA, 22 bp, Homo sapiens
gggctcagctgggcgtgctggt

SEQ ID NO: 10065248 - DNA, 21 bp, Homo sapiens
gggctcagcgctcggctcctc

SEQ ID NO: 10065249 - DNA, 22 bp, Homo sapiens
gggctcagctccttccttccta

SEQ ID NO: 10065250 - DNA, 22 bp, Homo sapiens
gggctcagttctgcttcatgct

SEQ ID NO: 10065251 - DNA, 22 bp, Homo sapiens
gggctcagacatccctcctgga

SEQ ID NO: 10065252 - DNA, 22 bp, Homo sapiens
gggccccaaaatgccaggctct

SEQ ID NO: 10065253 - DNA, 22 bp, Homo sapiens
gggccccactggggctgcctgc

SEQ ID NO: 10065254 - DNA, 22 bp, Homo sapiens
gggatcagactctgggatgtag

SEQ ID NO: 10065255 - DNA, 22 bp, Homo sapiens
gggagccttgggagtgccagcc

SEQ ID NO: 10065256 - DNA, 22 bp, Homo sapiens
gggagctgaaggagccggcggg

SEQ ID NO: 10065257 - DNA, 22 bp, Homo sapiens
gggagctgaatggcaatggaga

SEQ ID NO: 10065258 - DNA, 20 bp, Homo sapiens
gggatcaggaaaggaggcta

SEQ ID NO: 10065259 - DNA, 22 bp, Homo sapiens
gggatcagttaaggagagtttt

SEQ ID NO: 10065260 - DNA, 22 bp, Homo sapiens
gggcagagactcagaaacagaa

SEQ ID NO: 10065261 - DNA, 20 bp, Homo sapiens
gggcagagccagccagtccc

SEQ ID NO: 10065262 - DNA, 22 bp, Homo sapiens
gggcagagagctggaactcctt

SEQ ID NO: 10065263 - DNA, 22 bp, Homo sapiens
gcccctcccagtcaggagcact

SEQ ID NO: 10065264 - DNA, 22 bp, Homo sapiens
gcccctcccagtcaggagcact

SEQ ID NO: 10065265 - DNA, 22 bp, Homo sapiens
gcccctccgggcgcgtcatagc

SEQ ID NO: 10065266 - DNA, 22 bp, Homo sapiens
gcccaagtcagtgcttctggca

SEQ ID NO: 10065267 - DNA, 22 bp, Homo sapiens
gcctccctccaccactgcaggt

SEQ ID NO: 10065268 - DNA, 22 bp, Homo sapiens
gcctccctgagtcacccaagca

SEQ ID NO: 10065269 - DNA, 22 bp, Homo sapiens
gcctccctggcccacagcagcg

SEQ ID NO: 10065270 - DNA, 22 bp, Homo sapiens
gcctccctgtttcctgctccaa

SEQ ID NO: 10065271 - DNA, 22 bp, Homo sapiens
gcctccctgtagaggccagcct

SEQ ID NO: 10065272 - DNA, 22 bp, Homo sapiens
gcctccctgttcttccacaata

SEQ ID NO: 10065273 - DNA, 18 bp, Homo sapiens
gcctccctggctacactt

SEQ ID NO: 10065274 - DNA, 22 bp, Homo sapiens
gcctcccttggtgtctcccggg

SEQ ID NO: 10065275 - DNA, 22 bp, Homo sapiens
gccaggctccaggccctcctga

SEQ ID NO: 10065276 - DNA, 21 bp, Homo sapiens
gccacctcgtctcggagcagc

SEQ ID NO: 10065277 - DNA, 22 bp, Homo sapiens
gccacctctagcaaagctcagc

SEQ ID NO: 10065278 - DNA, 22 bp, Homo sapiens
gccacctcggctttctctgctc

SEQ ID NO: 10065279 - DNA, 20 bp, Homo sapiens
gccacctctctagcagtaga

SEQ ID NO: 10065280 - DNA, 22 bp, Homo sapiens
gccacctctctcttgactcgag

SEQ ID NO: 10065281 - DNA, 22 bp, Homo sapiens
gccacctctttgtctctgccgc

SEQ ID NO: 10065282 - DNA, 22 bp, Homo sapiens
gccacctcccaggacgaggctg

SEQ ID NO: 10065283 - DNA, 23 bp, Homo sapiens
gccacctcctggtcagaaagagg

SEQ ID NO: 10065284 - DNA, 22 bp, Homo sapiens
gccacctccttattccacctgt

SEQ ID NO: 10065285 - DNA, 21 bp, Homo sapiens
gccacctcaatcttctagcgc

SEQ ID NO: 10065286 - DNA, 18 bp, Homo sapiens
gccaccctcctcgtctcc

SEQ ID NO: 10065287 - DNA, 22 bp, Homo sapiens
gcagctgggacactgaggccag

SEQ ID NO: 10065288 - DNA, 22 bp, Homo sapiens
gcagctggtctggcctagagta

SEQ ID NO: 10065289 - DNA, 22 bp, Homo sapiens
gcagccagaagactcagaacaa

SEQ ID NO: 10065290 - DNA, 22 bp, Homo sapiens
gcagccaggaaagctggaccct

SEQ ID NO: 10065291 - DNA, 22 bp, Homo sapiens
gcagggcagcttagtccctgtc

SEQ ID NO: 10065292 - DNA, 22 bp, Homo sapiens
gcagggcagctgaagctaggtg

SEQ ID NO: 10065293 - DNA, 22 bp, Homo sapiens
gcagggcagctcactgtggttc

SEQ ID NO: 10065294 - DNA, 22 bp, Homo sapiens
gcagggcatgggccctgtctgc

SEQ ID NO: 10065295 - DNA, 22 bp, Homo sapiens
gcagggcagtaagagctagagt

SEQ ID NO: 10065296 - DNA, 22 bp, Homo sapiens
gcagggcaggatttgaacccag

SEQ ID NO: 10065297 - DNA, 22 bp, Homo sapiens
gcagggcagggcaagaactggg

SEQ ID NO: 10065298 - DNA, 22 bp, Homo sapiens
gcaggtctagaagctgcctctg

SEQ ID NO: 10065299 - DNA, 22 bp, Homo sapiens
gcacagagacagtcctgagatc

SEQ ID NO: 10065300 - DNA, 22 bp, Homo sapiens
gcacagagaggctgtgagcgcc

SEQ ID NO: 10065301 - DNA, 22 bp, Homo sapiens
gcacagagtgggtgagatgtgg

SEQ ID NO: 10065302 - DNA, 22 bp, Homo sapiens
gcaccaggaagctgttatagca

SEQ ID NO: 10065303 - DNA, 22 bp, Homo sapiens
gcaccaggagaatcacgttaga

SEQ ID NO: 10065304 - DNA, 22 bp, Homo sapiens
gcagcaaacttccacaagtaga

SEQ ID NO: 10065305 - DNA, 22 bp, Homo sapiens
gcagacagggctacagaggtac

SEQ ID NO: 10065306 - DNA, 22 bp, Homo sapiens
gctctcccgcagcctggtgggc

SEQ ID NO: 10065307 - DNA, 22 bp, Homo sapiens
gctctcctgtgcagatgctgct

SEQ ID NO: 10065308 - DNA, 22 bp, Homo sapiens
gctcccagcattgcttcccagg

SEQ ID NO: 10065309 - DNA, 22 bp, Homo sapiens
gctcccaggaagagaagggcca

SEQ ID NO: 10065310 - DNA, 22 bp, Homo sapiens
gctcccagctggagcctcaaca

SEQ ID NO: 10065311 - DNA, 22 bp, Homo sapiens
gctccctccatgaggcagaccg

SEQ ID NO: 10065312 - DNA, 22 bp, Homo sapiens
gctaggaggccctgcacgctta

SEQ ID NO: 10065313 - DNA, 22 bp, Homo sapiens
gctcagggagtttcacagtgta

SEQ ID NO: 10065314 - DNA, 22 bp, Homo sapiens
gctcagggccatggaccagcag

SEQ ID NO: 10065315 - DNA, 22 bp, Homo sapiens
gctcagggcctggctgcggact

SEQ ID NO: 10065316 - DNA, 20 bp, Homo sapiens
gctcagggcctgggtctgga

SEQ ID NO: 10065317 - DNA, 20 bp, Homo sapiens
gctcagggcctgggtctgga

SEQ ID NO: 10065318 - DNA, 22 bp, Homo sapiens
gctcagggaatgagaagatgtt

SEQ ID NO: 10065319 - DNA, 22 bp, Homo sapiens
gctcagggaaggccacgtgaga

SEQ ID NO: 10065320 - DNA, 22 bp, Homo sapiens
gctcagggagagagggcagccg

SEQ ID NO: 10065321 - DNA, 20 bp, Homo sapiens
gctcagggaattcaggaagc

SEQ ID NO: 10065322 - DNA, 22 bp, Homo sapiens
gctcccagcattgctgctgaat

SEQ ID NO: 10065323 - DNA, 22 bp, Homo sapiens
gctcccagatttcagccttgtg

SEQ ID NO: 10065324 - DNA, 22 bp, Homo sapiens
gctcagggcgcgagggacgtgg

SEQ ID NO: 10065325 - DNA, 22 bp, Homo sapiens
gctggaggtttcacctgagttt

SEQ ID NO: 10065326 - DNA, 22 bp, Homo sapiens
gctgcctcccccatggctggaa

SEQ ID NO: 10065327 - DNA, 22 bp, Homo sapiens
gctgaggttttctgcctgctca

SEQ ID NO: 10065328 - DNA, 22 bp, Homo sapiens
gctgagtgtaatgatggcagag

SEQ ID NO: 10065329 - DNA, 22 bp, Homo sapiens
gctgtcagtcacattgttacag

SEQ ID NO: 10065330 - DNA, 23 bp, Homo sapiens
gctgtctgtcatctctgcgggag

SEQ ID NO: 10065331 - DNA, 22 bp, Homo sapiens
gctgtctggaggctctgaggga

SEQ ID NO: 10065332 - DNA, 22 bp, Homo sapiens
gctgtctggcatggcgtggctg

SEQ ID NO: 10065333 - DNA, 22 bp, Homo sapiens
gctgtatgagttcatgtgtaga

SEQ ID NO: 10065334 - DNA, 22 bp, Homo sapiens
gctttgggggctgcagtgcgtg

SEQ ID NO: 10065335 - DNA, 20 bp, Homo sapiens
gctttaagacacagctaaaa

SEQ ID NO: 10065336 - DNA, 22 bp, Homo sapiens
gctgtgtgttcaataatgtgat

SEQ ID NO: 10065337 - DNA, 22 bp, Homo sapiens
ggagccaggcaatctgtacttt

SEQ ID NO: 10065338 - DNA, 22 bp, Homo sapiens
ggagcccaagtctgcactcggc

SEQ ID NO: 10065339 - DNA, 22 bp, Homo sapiens
ggagcctgggcctcctgccctt

SEQ ID NO: 10065340 - DNA, 22 bp, Homo sapiens
ggacaggcccggggagcctgga

SEQ ID NO: 10065341 - DNA, 22 bp, Homo sapiens
ggacagggctcttggcactcct

SEQ ID NO: 10065342 - DNA, 22 bp, Homo sapiens
ggacaggggcgtggggattgtt

SEQ ID NO: 10065343 - DNA, 22 bp, Homo sapiens
ggacttggcttctttcagagac

SEQ ID NO: 10065344 - DNA, 19 bp, Homo sapiens
ggacttggtttccaggctc

SEQ ID NO: 10065345 - DNA, 22 bp, Homo sapiens
ggagaaagctatgtgggggagt

SEQ ID NO: 10065346 - DNA, 22 bp, Homo sapiens
ctccagaggttctcatctggga

SEQ ID NO: 10065347 - DNA, 22 bp, Homo sapiens
ctccagagtcacactgcctggg

SEQ ID NO: 10065348 - DNA, 20 bp, Homo sapiens
ttggctctgatcagtggagc

SEQ ID NO: 10065349 - DNA, 22 bp, Homo sapiens
ttggctgagccatgtgaaacca

SEQ ID NO: 10065350 - DNA, 22 bp, Homo sapiens
ctccaggacagattcagggcca

SEQ ID NO: 10065351 - DNA, 22 bp, Homo sapiens
ctccaggaccagggctcctgga

SEQ ID NO: 10065352 - DNA, 22 bp, Homo sapiens
ctccaggactcaggcccctggg

SEQ ID NO: 10065353 - DNA, 22 bp, Homo sapiens
ctcagggcagtatggctgagag

SEQ ID NO: 10065354 - DNA, 22 bp, Homo sapiens
ctcagggctctgcatgcacacg

SEQ ID NO: 10065355 - DNA, 22 bp, Homo sapiens
ctcagggctggaaagccaggaa

SEQ ID NO: 10065356 - DNA, 22 bp, Homo sapiens
ctcagggccaaggatgctgttg

SEQ ID NO: 10065357 - DNA, 22 bp, Homo sapiens
ctcagggcggcgggcagcccag

SEQ ID NO: 10065358 - DNA, 18 bp, Homo sapiens
ctcagggcatcagtctgg

SEQ ID NO: 10065359 - DNA, 21 bp, Homo sapiens
ctcagggcttggtgtcctcat

SEQ ID NO: 10065360 - DNA, 22 bp, Homo sapiens
ctcagggcttgagtgtccagga

SEQ ID NO: 10065361 - DNA, 22 bp, Homo sapiens
ctcaggggacctggctccgagt

SEQ ID NO: 10065362 - DNA, 22 bp, Homo sapiens
ctcagagcccagggtacacccg

SEQ ID NO: 10065363 - DNA, 22 bp, Homo sapiens
ctcagagctgaggccagggaca

SEQ ID NO: 10065364 - DNA, 21 bp, Homo sapiens
ctcagagcagttcagagggat

SEQ ID NO: 10065365 - DNA, 21 bp, Homo sapiens
ctcagagcagttcagagggat

SEQ ID NO: 10065366 - DNA, 22 bp, Homo sapiens
ctcagagccagttagcaggtgc

SEQ ID NO: 10065367 - DNA, 22 bp, Homo sapiens
ctcagagcaatgaacatgcaaa

SEQ ID NO: 10065368 - DNA, 22 bp, Homo sapiens
ctcagagagacaatgtgggaca

SEQ ID NO: 10065369 - DNA, 17 bp, Homo sapiens
ctcagagagggtaagta

SEQ ID NO: 10065370 - DNA, 21 bp, Homo sapiens
ctcagagaaatgtctgggagc

SEQ ID NO: 10065371 - DNA, 22 bp, Homo sapiens
cgggcaaggcgagactaggccc

SEQ ID NO: 10065372 - DNA, 22 bp, Homo sapiens
tgtcagcaattctggcttactc

SEQ ID NO: 10065373 - DNA, 20 bp, Homo sapiens
tgtcagcaattaggagaaaa

SEQ ID NO: 10065374 - DNA, 22 bp, Homo sapiens
tgtcagcattgcgtcactgagc

SEQ ID NO: 10065375 - DNA, 22 bp, Homo sapiens
tgtcagcatttaaggagtaagg

SEQ ID NO: 10065376 - DNA, 22 bp, Homo sapiens
ccttcagacctagacaggaatc

SEQ ID NO: 10065377 - DNA, 23 bp, Homo sapiens
ccttcagaagaagtaacaggggc

SEQ ID NO: 10065378 - DNA, 22 bp, Homo sapiens
ctgcccccaggctgcatggctg

SEQ ID NO: 10065379 - DNA, 22 bp, Homo sapiens
ctcttcttatggccgtggctga

SEQ ID NO: 10065380 - DNA, 22 bp, Homo sapiens
ctcttctgtacctcggcctcca

SEQ ID NO: 10065381 - DNA, 22 bp, Homo sapiens
ctgagcagtgctttgcagtggg

SEQ ID NO: 10065382 - DNA, 22 bp, Homo sapiens
ctgagcagtggttcttgagcgc

SEQ ID NO: 10065383 - DNA, 22 bp, Homo sapiens
ctgagcagtctgactcaagcta

SEQ ID NO: 10065384 - DNA, 22 bp, Homo sapiens
ctgagcagtagagggtctcttt

SEQ ID NO: 10065385 - DNA, 22 bp, Homo sapiens
ctgagcaggatattcacagcag

SEQ ID NO: 10065386 - DNA, 19 bp, Homo sapiens
ctgagcagcggcagcactt

SEQ ID NO: 10065387 - DNA, 22 bp, Homo sapiens
ctgagcagctccctgagtggtc

SEQ ID NO: 10065388 - DNA, 22 bp, Homo sapiens
ctgagcagaagggtgcacgtgc

SEQ ID NO: 10065389 - DNA, 17 bp, Homo sapiens
ctgaggggagtgctgtg

SEQ ID NO: 10065390 - DNA, 22 bp, Homo sapiens
ctgagcagtttcttagggctca

SEQ ID NO: 10065391 - DNA, 22 bp, Homo sapiens
ctggagaaaatccatgtgtatg

SEQ ID NO: 10065392 - DNA, 22 bp, Homo sapiens
ctgcctgttagtctagcagtta

SEQ ID NO: 10065393 - DNA, 22 bp, Homo sapiens
ctgcccctgccaggcagctgtc

SEQ ID NO: 10065394 - DNA, 22 bp, Homo sapiens
ctgctctgtttcttagctgggt

SEQ ID NO: 10065395 - DNA, 19 bp, Homo sapiens
ctgctgggtgctgagggag

SEQ ID NO: 10065396 - DNA, 22 bp, Homo sapiens
ctctgtgggccagagaggcccc

SEQ ID NO: 10065397 - DNA, 22 bp, Homo sapiens
ctctgtgggggagaggcagctg

SEQ ID NO: 10065398 - DNA, 22 bp, Homo sapiens
ctccaggcccacgtcgaggagg

SEQ ID NO: 10065399 - DNA, 22 bp, Homo sapiens
ctccaggcccctggccttctgc

SEQ ID NO: 10065400 - DNA, 22 bp, Homo sapiens
ctccaggccagggaagtggaca

SEQ ID NO: 10065401 - DNA, 22 bp, Homo sapiens
ctccaggccaagattaagtaat

SEQ ID NO: 10065402 - DNA, 22 bp, Homo sapiens
ctccaggccatggctgcggagg

SEQ ID NO: 10065403 - DNA, 22 bp, Homo sapiens
ctccaggcccacggccgcggcc

SEQ ID NO: 10065404 - DNA, 22 bp, Homo sapiens
ctccaggcccacgtcgaggagg

SEQ ID NO: 10065405 - DNA, 22 bp, Homo sapiens
ctccaggccatggctgcggagg

SEQ ID NO: 10065406 - DNA, 22 bp, Homo sapiens
ctccaggcccacggccgcggcc

SEQ ID NO: 10065407 - DNA, 22 bp, Homo sapiens
ctccaggagggcttcctgtgat

SEQ ID NO: 10065408 - DNA, 16 bp, Homo sapiens
ctccaggcaagaatgg

SEQ ID NO: 10065409 - DNA, 22 bp, Homo sapiens
ctccttcctggttagcacctta

SEQ ID NO: 10065410 - DNA, 22 bp, Homo sapiens
ctccttcctgccccagtgataa

SEQ ID NO: 10065411 - DNA, 22 bp, Homo sapiens
ctccttccaacaagagaaagag

SEQ ID NO: 10065412 - DNA, 22 bp, Homo sapiens
ctccttcccatgagtgtgggca

SEQ ID NO: 10065413 - DNA, 22 bp, Homo sapiens
ctccttcccctactcagcatcc

SEQ ID NO: 10065414 - DNA, 22 bp, Homo sapiens
ctccttccctaccatcaatgtt

SEQ ID NO: 10065415 - DNA, 19 bp, Homo sapiens
ctccttccctggtttctgt

SEQ ID NO: 10065416 - DNA, 22 bp, Homo sapiens
ctccttcctgcagatctgagat

SEQ ID NO: 10065417 - DNA, 22 bp, Homo sapiens
ctccttcccttcaagtgttcct

SEQ ID NO: 10065418 - DNA, 22 bp, Homo sapiens
ctctctgtcttggcatttggtc

SEQ ID NO: 10065419 - DNA, 22 bp, Homo sapiens
tttctcaaaagacagaagtgaa

SEQ ID NO: 10065420 - DNA, 22 bp, Homo sapiens
tttcctttctcaagagccggca

SEQ ID NO: 10065421 - DNA, 22 bp, Homo sapiens
cttgctggggtaagtctgtgct

SEQ ID NO: 10065422 - DNA, 22 bp, Homo sapiens
cttcttctctacatcctttgat

SEQ ID NO: 10065423 - DNA, 22 bp, Homo sapiens
cttcttcctgctgcagcctcca

SEQ ID NO: 10065424 - DNA, 22 bp, Homo sapiens
cttcacagtcaccctgctgtgt

SEQ ID NO: 10065425 - DNA, 22 bp, Homo sapiens
cttcacaggcaagtctgttttt

SEQ ID NO: 10065426 - DNA, 22 bp, Homo sapiens
cttcacagatgctgagagggct

SEQ ID NO: 10065427 - DNA, 22 bp, Homo sapiens
gaaaccagctagaggcagaggg

SEQ ID NO: 10065428 - DNA, 22 bp, Homo sapiens
gaaatgtgggtcatgacccatt

SEQ ID NO: 10065429 - DNA, 22 bp, Homo sapiens
ctgtgggatgggacctcagctg

SEQ ID NO: 10065430 - DNA, 22 bp, Homo sapiens
ctgggggtgagcagcagcgacg

SEQ ID NO: 10065431 - DNA, 22 bp, Homo sapiens
gagcacacagtgtgcctgtgta

SEQ ID NO: 10065432 - DNA, 22 bp, Homo sapiens
gagcacagtccttttgttaaaa

SEQ ID NO: 10065433 - DNA, 22 bp, Homo sapiens
gagcacagtgtgttgtgatttc

SEQ ID NO: 10065434 - DNA, 22 bp, Homo sapiens
gagcacctcaaatgaacataaa

SEQ ID NO: 10065435 - DNA, 22 bp, Homo sapiens
gagcacttaatcctgttattca

SEQ ID NO: 10065436 - DNA, 22 bp, Homo sapiens
gagagacagcagaacgtgcagc

SEQ ID NO: 10065437 - DNA, 22 bp, Homo sapiens
gagagcagactctcaaagctgg

SEQ ID NO: 10065438 - DNA, 22 bp, Homo sapiens
gagagagaaccccgtgcccttc

SEQ ID NO: 10065439 - DNA, 22 bp, Homo sapiens
gagagagaaaatgactccggac

SEQ ID NO: 10065440 - DNA, 22 bp, Homo sapiens
gagagccctgcatggctgatga

SEQ ID NO: 10065441 - DNA, 22 bp, Homo sapiens
gagaacaggctctggagtcaga

SEQ ID NO: 10065442 - DNA, 22 bp, Homo sapiens
gagaagcaatcgtgacatctcc

SEQ ID NO: 10065443 - DNA, 22 bp, Homo sapiens
gagaagcaggtttagcagacaa

SEQ ID NO: 10065444 - DNA, 22 bp, Homo sapiens
gacagctgcttatgaaccaacg

SEQ ID NO: 10065445 - DNA, 22 bp, Homo sapiens
gacctgggtaaggggctgacaa

SEQ ID NO: 10065446 - DNA, 22 bp, Homo sapiens
gacctggtccttgtactttgaa

SEQ ID NO: 10065447 - DNA, 22 bp, Homo sapiens
gacatgggatgagatgaagcat

SEQ ID NO: 10065448 - DNA, 22 bp, Homo sapiens
gacatgcaatgcagtggtaagt

SEQ ID NO: 10065449 - DNA, 22 bp, Homo sapiens
gacatgcagttctcaagggtag

SEQ ID NO: 10065450 - DNA, 22 bp, Homo sapiens
gacatgcataacaagattggaa

SEQ ID NO: 10065451 - DNA, 22 bp, Homo sapiens
gacatgcaacaatttggcattt

SEQ ID NO: 10065452 - DNA, 22 bp, Homo sapiens
gagctgggtctccaccttggca

SEQ ID NO: 10065453 - DNA, 18 bp, Homo sapiens
gagctgtctgagctggtc

SEQ ID NO: 10065454 - DNA, 22 bp, Homo sapiens
gagctgtccaagatggtcgtaa

SEQ ID NO: 10065455 - DNA, 22 bp, Homo sapiens
gagctcagcactaaaatcatgt

SEQ ID NO: 10065456 - DNA, 22 bp, Homo sapiens
gaggccagatactctcttctgc

SEQ ID NO: 10065457 - DNA, 22 bp, Homo sapiens
gaggccagaatgagtctctggg

SEQ ID NO: 10065458 - DNA, 22 bp, Homo sapiens
gaggtgctgctgtacttcttgc

SEQ ID NO: 10065459 - DNA, 22 bp, Homo sapiens
gagggctgataaatgcgcatgg

SEQ ID NO: 10065460 - DNA, 22 bp, Homo sapiens
gaggctggtttgccttttggca

SEQ ID NO: 10065461 - DNA, 22 bp, Homo sapiens
tgagcacctactagaatgctaa

SEQ ID NO: 10065462 - DNA, 22 bp, Homo sapiens
ccagggtgtgggcgtcggcacg

SEQ ID NO: 10065463 - DNA, 22 bp, Homo sapiens
ccagtggccatgcacgagcagc

SEQ ID NO: 10065464 - DNA, 22 bp, Homo sapiens
tgagaaaactcaaagacagatc

SEQ ID NO: 10065465 - DNA, 22 bp, Homo sapiens
tgacagagtcggggcaagctgt

SEQ ID NO: 10065466 - DNA, 22 bp, Homo sapiens
ccagggcatgtccaagacttag

SEQ ID NO: 10065467 - DNA, 22 bp, Homo sapiens
ccagggcatgtaactaatggtg

SEQ ID NO: 10065468 - DNA, 22 bp, Homo sapiens
tgacagagacttcagagccaaa

SEQ ID NO: 10065469 - DNA, 22 bp, Homo sapiens
ccaggctcagcgcgcacgtctg

SEQ ID NO: 10065470 - DNA, 22 bp, Homo sapiens
ccaggctcagctattaagaaac

SEQ ID NO: 10065471 - DNA, 22 bp, Homo sapiens
ccaggctcagggcagactttca

SEQ ID NO: 10065472 - DNA, 22 bp, Homo sapiens
ccaggctcaggcctgctcgttg

SEQ ID NO: 10065473 - DNA, 22 bp, Homo sapiens
ccaggctcaggtgcgagagaca

SEQ ID NO: 10065474 - DNA, 22 bp, Homo sapiens
ccaggctccccaggaggccctt

SEQ ID NO: 10065475 - DNA, 17 bp, Homo sapiens
ccaggctccatcactgt

SEQ ID NO: 10065476 - DNA, 22 bp, Homo sapiens
ccaggctcacctggagcccctg

SEQ ID NO: 10065477 - DNA, 22 bp, Homo sapiens
ccaggctcactgactaccacat

SEQ ID NO: 10065478 - DNA, 22 bp, Homo sapiens
ccaggctcacagcatcccagga

SEQ ID NO: 10065479 - DNA, 21 bp, Homo sapiens
ccagcctcagatcagggagct

SEQ ID NO: 10065480 - DNA, 22 bp, Homo sapiens
ccaggctccgcatagaccccac

SEQ ID NO: 10065481 - DNA, 22 bp, Homo sapiens
ccaggctcctcatgatcttgtt

SEQ ID NO: 10065482 - DNA, 22 bp, Homo sapiens
tgccctcctcctgagcccatgt

SEQ ID NO: 10065483 - DNA, 22 bp, Homo sapiens
tgccctcttaggtctgcgcagc

SEQ ID NO: 10065484 - DNA, 21 bp, Homo sapiens
cccaggaggctgagaagagca

SEQ ID NO: 10065485 - DNA, 23 bp, Homo sapiens
tgcctcagtggaatgtgagggtg

SEQ ID NO: 10065486 - DNA, 22 bp, Homo sapiens
cccaggaggcagagatagcagt

SEQ ID NO: 10065487 - DNA, 22 bp, Homo sapiens
cccaggagacatatagaaggac

SEQ ID NO: 10065488 - DNA, 21 bp, Homo sapiens
cccaggagaagaaaagatgca

SEQ ID NO: 10065489 - DNA, 22 bp, Homo sapiens
tgatgaattggaaattctgatt

SEQ ID NO: 10065490 - DNA, 22 bp, Homo sapiens
cccaagcagggtgcagaggcat

SEQ ID NO: 10065491 - DNA, 22 bp, Homo sapiens
tgattagattgagtcaaccttg

SEQ ID NO: 10065492 - DNA, 17 bp, Homo sapiens
tgattcaactagaaact

SEQ ID NO: 10065493 - DNA, 22 bp, Homo sapiens
cccacaggcaggtgcatgggct

SEQ ID NO: 10065494 - DNA, 18 bp, Homo sapiens
cccagcactttgggagcc

SEQ ID NO: 10065495 - DNA, 22 bp, Homo sapiens
cctcagaagctcaaggacattg

SEQ ID NO: 10065496 - DNA, 22 bp, Homo sapiens
tggctcagcgcggcctggtctt

SEQ ID NO: 10065497 - DNA, 22 bp, Homo sapiens
tggctcagccattcgtgttgcc

SEQ ID NO: 10065498 - DNA, 22 bp, Homo sapiens
tggctcagcctggccctttcat

SEQ ID NO: 10065499 - DNA, 22 bp, Homo sapiens
tggctcagcggtggcagcagac

SEQ ID NO: 10065500 - DNA, 23 bp, Homo sapiens
tggctcagctagttttccatttc

SEQ ID NO: 10065501 - DNA, 22 bp, Homo sapiens
cctcccaggcattgccattttc

SEQ ID NO: 10065502 - DNA, 22 bp, Homo sapiens
tggctcagctgactcggcttct

SEQ ID NO: 10065503 - DNA, 19 bp, Homo sapiens
cctccccttggaccagcaa

SEQ ID NO: 10065504 - DNA, 22 bp, Homo sapiens
cctccctctttcagtcccacag

SEQ ID NO: 10065505 - DNA, 22 bp, Homo sapiens
cctcacagaggggcagccatct

SEQ ID NO: 10065506 - DNA, 17 bp, Homo sapiens
cctcacagggaccagac

SEQ ID NO: 10065507 - DNA, 22 bp, Homo sapiens
ccggctcggcgaccaggctgaa

SEQ ID NO: 10065508 - DNA, 22 bp, Homo sapiens
ccgggggaggcaagagacatgc

SEQ ID NO: 10065509 - DNA, 22 bp, Homo sapiens
ccgggggactactgggaaactg

SEQ ID NO: 10065510 - DNA, 22 bp, Homo sapiens
tgcctgctagatatccaggtga

SEQ ID NO: 10065511 - DNA, 22 bp, Homo sapiens
tgcctgctccagtcctgtccac

SEQ ID NO: 10065512 - DNA, 22 bp, Homo sapiens
ccctgcctgtgggcatcaacat

SEQ ID NO: 10065513 - DNA, 22 bp, Homo sapiens
ccctgcctctgaagctgctcag

SEQ ID NO: 10065514 - DNA, 22 bp, Homo sapiens
tggacaggtttgggtgcctgtt

SEQ ID NO: 10065515 - DNA, 22 bp, Homo sapiens
ccctgccttggggtccacaccg

SEQ ID NO: 10065516 - DNA, 22 bp, Homo sapiens
tggaggccaggaaggcagcgag

SEQ ID NO: 10065517 - DNA, 22 bp, Homo sapiens
tggaggccacatgaacgctgcg

SEQ ID NO: 10065518 - DNA, 22 bp, Homo sapiens
tgtcaacagatctcaaagctgg

SEQ ID NO: 10065519 - DNA, 22 bp, Homo sapiens
cctgcctgtactagagacccag

SEQ ID NO: 10065520 - DNA, 22 bp, Homo sapiens
tgggtcagaatcagagagttgc

SEQ ID NO: 10065521 - DNA, 17 bp, Homo sapiens
tggtctggaagaactga

SEQ ID NO: 10065522 - DNA, 22 bp, Homo sapiens
cctgctggacgtggaggagggg

SEQ ID NO: 10065523 - DNA, 22 bp, Homo sapiens
cctgctggccactgctccacct

SEQ ID NO: 10065524 - DNA, 22 bp, Homo sapiens
cctctggcaacttcacagccca

SEQ ID NO: 10065525 - DNA, 22 bp, Homo sapiens
tgggagctcacaggcctggctc

SEQ ID NO: 10065526 - DNA, 23 bp, Homo sapiens
tgggagctcaagggaggctgccc

SEQ ID NO: 10065527 - DNA, 22 bp, Homo sapiens
tggctctccagctctaaggcct

SEQ ID NO: 10065528 - DNA, 22 bp, Homo sapiens
cctccctgcgctcctgcggcgg

SEQ ID NO: 10065529 - DNA, 22 bp, Homo sapiens
cctgaaggaaactggaaataca

SEQ ID NO: 10065530 - DNA, 22 bp, Homo sapiens
tgggcagggagctggaaccaca

SEQ ID NO: 10065531 - DNA, 22 bp, Homo sapiens
cctgcaccacactcactgctca

SEQ ID NO: 10065532 - DNA, 22 bp, Homo sapiens
cctgcacagccttggctgacac

SEQ ID NO: 10065533 - DNA, 22 bp, Homo sapiens
tggggtacacgtggggcaggat

SEQ ID NO: 10065534 - DNA, 22 bp, Homo sapiens
tggggtacttgtatcaaagcac

SEQ ID NO: 10065535 - DNA, 22 bp, Homo sapiens
cagggcacggagaagtcacccc

SEQ ID NO: 10065536 - DNA, 20 bp, Homo sapiens
cagggcacactgcagcctcg

SEQ ID NO: 10065537 - DNA, 22 bp, Homo sapiens
cagggcaaggcagagcgtcccc

SEQ ID NO: 10065538 - DNA, 22 bp, Homo sapiens
cagggcaaagtcttctagaacc

SEQ ID NO: 10065539 - DNA, 22 bp, Homo sapiens
caggctggtcccagagcattgc

SEQ ID NO: 10065540 - DNA, 17 bp, Homo sapiens
tagagctggttcaggag

SEQ ID NO: 10065541 - DNA, 22 bp, Homo sapiens
caggctggagtgcaatggtgct

SEQ ID NO: 10065542 - DNA, 22 bp, Homo sapiens
caggctggagtgcagtggggcg

SEQ ID NO: 10065543 - DNA, 22 bp, Homo sapiens
taggagaggtgaatggcacact

SEQ ID NO: 10065544 - DNA, 22 bp, Homo sapiens
cagggcctgtacaagtcccacc

SEQ ID NO: 10065545 - DNA, 22 bp, Homo sapiens
cagggccttcgtaagtgtccgg

SEQ ID NO: 10065546 - DNA, 22 bp, Homo sapiens
cagggccttgttcaggagtgaa

SEQ ID NO: 10065547 - DNA, 22 bp, Homo sapiens
cagggctcagggactgcagaaa

SEQ ID NO: 10065548 - DNA, 22 bp, Homo sapiens
cagggctcaggctctgggattc

SEQ ID NO: 10065549 - DNA, 22 bp, Homo sapiens
cagggcagagggaaactccttt

SEQ ID NO: 10065550 - DNA, 22 bp, Homo sapiens
caggggacattaaagctccata

SEQ ID NO: 10065551 - DNA, 22 bp, Homo sapiens
caggggacagtatggtggatga

SEQ ID NO: 10065552 - DNA, 22 bp, Homo sapiens
caggggacactcctgcttgggc

SEQ ID NO: 10065553 - DNA, 22 bp, Homo sapiens
cagggctttgtaatatgagcac

SEQ ID NO: 10065554 - DNA, 22 bp, Homo sapiens
cagggctttcccttgtagaaat

SEQ ID NO: 10065555 - DNA, 22 bp, Homo sapiens
caggggagttttatgcaacaga

SEQ ID NO: 10065556 - DNA, 22 bp, Homo sapiens
caggggcaagaatgctgtcagc

SEQ ID NO: 10065557 - DNA, 22 bp, Homo sapiens
cagtgagagtatttgtgctaag

SEQ ID NO: 10065558 - DNA, 22 bp, Homo sapiens
tcacacttatcccactcagtca

SEQ ID NO: 10065559 - DNA, 22 bp, Homo sapiens
cagtgagcacggccagagggga

SEQ ID NO: 10065560 - DNA, 22 bp, Homo sapiens
cagtccagagcccaccagagga

SEQ ID NO: 10065561 - DNA, 22 bp, Homo sapiens
cagtgggattgggattggaacc

SEQ ID NO: 10065562 - DNA, 22 bp, Homo sapiens
cagtgggagcaaatacactcat

SEQ ID NO: 10065563 - DNA, 21 bp, Homo sapiens
cagtggcagttcttgcctctg

SEQ ID NO: 10065564 - DNA, 22 bp, Homo sapiens
cagtggcaggggaagcaggtgt

SEQ ID NO: 10065565 - DNA, 22 bp, Homo sapiens
tcagagaaaatggaaactttta

SEQ ID NO: 10065566 - DNA, 22 bp, Homo sapiens
ccacctccacctattgccagcc

SEQ ID NO: 10065567 - DNA, 23 bp, Homo sapiens
tctcaagcttcactgtgtgttgt

SEQ ID NO: 10065568 - DNA, 22 bp, Homo sapiens
tctcaagctactaccttggatc

SEQ ID NO: 10065569 - DNA, 22 bp, Homo sapiens
tctccaggaaccatcatggtaa

SEQ ID NO: 10065570 - DNA, 22 bp, Homo sapiens
tctccaggaagccctccctgac

SEQ ID NO: 10065571 - DNA, 22 bp, Homo sapiens
tctccagaaatggggctgggga

SEQ ID NO: 10065572 - DNA, 22 bp, Homo sapiens
tctccctctttgtctgctttgg

SEQ ID NO: 10065573 - DNA, 22 bp, Homo sapiens
tctccctggagccctgaagcat

SEQ ID NO: 10065574 - DNA, 22 bp, Homo sapiens
tcgccccgaggcagccctatgc

SEQ ID NO: 10065575 - DNA, 22 bp, Homo sapiens
ccaccacttctggcttctggtg

SEQ ID NO: 10065576 - DNA, 20 bp, Homo sapiens
tccaggcagctcagagtgtc

SEQ ID NO: 10065577 - DNA, 22 bp, Homo sapiens
tccaggcccatggagcagagct

SEQ ID NO: 10065578 - DNA, 22 bp, Homo sapiens
tccctaggtcctagtcacagta

SEQ ID NO: 10065579 - DNA, 21 bp, Homo sapiens
tcctctccatgatctgtttgt

SEQ ID NO: 10065580 - DNA, 22 bp, Homo sapiens
tcctctccatattttctgattt

SEQ ID NO: 10065581 - DNA, 22 bp, Homo sapiens
tcccaggatctgagggcagaga

SEQ ID NO: 10065582 - DNA, 18 bp, Homo sapiens
cattcttggcagcttttg

SEQ ID NO: 10065583 - DNA, 22 bp, Homo sapiens
tcccagggtcctcttctggaat

SEQ ID NO: 10065584 - DNA, 22 bp, Homo sapiens
tccctaggagaattgccgcagc

SEQ ID NO: 10065585 - DNA, 22 bp, Homo sapiens
catgttcatcagatcaattgta

SEQ ID NO: 10065586 - DNA, 22 bp, Homo sapiens
catgttcacctgtggcactagt

SEQ ID NO: 10065587 - DNA, 22 bp, Homo sapiens
tcccagccacagtttccacctg

SEQ ID NO: 10065588 - DNA, 22 bp, Homo sapiens
tcccagagctctggaggttgga

SEQ ID NO: 10065589 - DNA, 22 bp, Homo sapiens
tttggtcttggatttatcagtg

SEQ ID NO: 10065590 - DNA, 22 bp, Homo sapiens
tttggtccaagttttactcttt

SEQ ID NO: 10065591 - DNA, 18 bp, Homo sapiens
tttggtcctttataaaca

SEQ ID NO: 10065592 - DNA, 22 bp, Homo sapiens
tttggtccttcatacttccttt

SEQ ID NO: 10065593 - DNA, 22 bp, Homo sapiens
tttggtcctatgagcaagtttc

SEQ ID NO: 10065594 - DNA, 22 bp, Homo sapiens
tttggtcctctctctgtgtgtg

SEQ ID NO: 10065595 - DNA, 22 bp, Homo sapiens
tttggtcctgagcaaaactatg

SEQ ID NO: 10065596 - DNA, 22 bp, Homo sapiens
tttggtccattatatgctgtca

SEQ ID NO: 10065597 - DNA, 22 bp, Homo sapiens
tttggtccatttgctcttacat

SEQ ID NO: 10065598 - DNA, 22 bp, Homo sapiens
tttggtccagcagtcccacttc

SEQ ID NO: 10065599 - DNA, 22 bp, Homo sapiens
tttggtcccagttctgtcatgg

SEQ ID NO: 10065600 - DNA, 21 bp, Homo sapiens
tttggtcccctcacctcctgg

SEQ ID NO: 10065601 - DNA, 22 bp, Homo sapiens
tttggtccctccctgcagctca

SEQ ID NO: 10065602 - DNA, 22 bp, Homo sapiens
tttggtcctaagctgctctcta

SEQ ID NO: 10065603 - DNA, 17 bp, Homo sapiens
ttctgtgcttcctggct

SEQ ID NO: 10065604 - DNA, 22 bp, Homo sapiens
ttctgtgctcaaaactttccaa

SEQ ID NO: 10065605 - DNA, 18 bp, Homo sapiens
ttctgtgcatctttctat

SEQ ID NO: 10065606 - DNA, 22 bp, Homo sapiens
ttccaggctgcagttgtagtta

SEQ ID NO: 10065607 - DNA, 22 bp, Homo sapiens
ttccaggctgcacagttgggac

SEQ ID NO: 10065608 - DNA, 22 bp, Homo sapiens
ttccaggctgcagttttctagt

SEQ ID NO: 10065609 - DNA, 22 bp, Homo sapiens
ttccaggcttctctggggcgtc

SEQ ID NO: 10065610 - DNA, 22 bp, Homo sapiens
ttccaggctattccctttggag

SEQ ID NO: 10065611 - DNA, 22 bp, Homo sapiens
ttccaggctcccttggaggtgt

SEQ ID NO: 10065612 - DNA, 22 bp, Homo sapiens
ttccaggctcctgcagtttcta

SEQ ID NO: 10065613 - DNA, 22 bp, Homo sapiens
ttccaggctgatgggccacagg

SEQ ID NO: 10065614 - DNA, 22 bp, Homo sapiens
ttccaggctcttccaggctgtc

SEQ ID NO: 10065615 - DNA, 22 bp, Homo sapiens
ttccaggcgcacgtcggcctta

SEQ ID NO: 10065616 - DNA, 22 bp, Homo sapiens
ttccaggctatccggtgaaggg

SEQ ID NO: 10065617 - DNA, 22 bp, Homo sapiens
ttccaggcattaaagtttctcc

SEQ ID NO: 10065618 - DNA, 22 bp, Homo sapiens
ttccaggccagaatggtcacat

SEQ ID NO: 10065619 - DNA, 22 bp, Homo sapiens
ttccaggcattacagggtttgc

SEQ ID NO: 10065620 - DNA, 23 bp, Homo sapiens
ttccaggcagagcagggattaga

SEQ ID NO: 10065621 - DNA, 22 bp, Homo sapiens
ttccaggcatgtcagacatagg

SEQ ID NO: 10065622 - DNA, 22 bp, Homo sapiens
ttccaggcagaacaatcatgct

SEQ ID NO: 10065623 - DNA, 22 bp, Homo sapiens
ttcagagctggtgtctacagct

SEQ ID NO: 10065624 - DNA, 16 bp, Homo sapiens
ttcagagcggctcata

SEQ ID NO: 10065625 - DNA, 20 bp, Homo sapiens
ttcagagatagggtctttaa

SEQ ID NO: 10065626 - DNA, 22 bp, Homo sapiens
ttcagagagtccagtatgcagt

SEQ ID NO: 10065627 - DNA, 22 bp, Homo sapiens
ttcagagcatctctaaagccag

SEQ ID NO: 10065628 - DNA, 22 bp, Homo sapiens
ttcagagagaaaccagtgggaa

SEQ ID NO: 10065629 - DNA, 22 bp, Homo sapiens
ttcagagacatgttctagatca

SEQ ID NO: 10065630 - DNA, 22 bp, Homo sapiens
ttcagagaaactgaggtttaga

SEQ ID NO: 10065631 - DNA, 22 bp, Homo sapiens
ttcaaagagttgggtgtctggg

SEQ ID NO: 10065632 - DNA, 22 bp, Homo sapiens
ttggactggtttacatttcaag

SEQ ID NO: 10065633 - DNA, 22 bp, Homo sapiens
ttggactgaatctttctcacac

SEQ ID NO: 10065634 - DNA, 22 bp, Homo sapiens
ttggactgagagttccaccatt

SEQ ID NO: 10065635 - DNA, 22 bp, Homo sapiens
ttgggagcttggccgagatgta

SEQ ID NO: 10065636 - DNA, 22 bp, Homo sapiens
ttgggagctggaagcaaggcct

SEQ ID NO: 10065637 - DNA, 19 bp, Homo sapiens
ttgctcccaccccagtttt

SEQ ID NO: 10065638 - DNA, 22 bp, Homo sapiens
ttgctgacctttgctctccgtt

SEQ ID NO: 10065639 - DNA, 22 bp, Homo sapiens
ttggaaaggtgcttttgtctgt

SEQ ID NO: 10065640 - DNA, 22 bp, Homo sapiens
ttggaaaatgtatttctagaag

SEQ ID NO: 10065641 - DNA, 22 bp, Homo sapiens
tttaagtgatgaaatgcagata

SEQ ID NO: 10065642 - DNA, 22 bp, Homo sapiens
tttaaacatatctgttgaggga

SEQ ID NO: 10065643 - DNA, 22 bp, Homo sapiens
tttcagagcctttatctctcta

SEQ ID NO: 10065644 - DNA, 22 bp, Homo sapiens
gaaaagagaacatctgaggatc

SEQ ID NO: 10065645 - DNA, 22 bp, Homo sapiens
atgaatggtgaagtctgataag

SEQ ID NO: 10065646 - DNA, 22 bp, Homo sapiens
gaaatgatgtctgtgctgccac

SEQ ID NO: 10065647 - DNA, 22 bp, Homo sapiens
atgcctcctcaaatctgccaca

SEQ ID NO: 10065648 - DNA, 22 bp, Homo sapiens
gacagggccgcagatggagact

SEQ ID NO: 10065649 - DNA, 22 bp, Homo sapiens
gacagggaggagcagagcttct

SEQ ID NO: 10065650 - DNA, 22 bp, Homo sapiens
gacagggaggaaagagactgct

SEQ ID NO: 10065651 - DNA, 22 bp, Homo sapiens
gagcggaggcttggaggccagc

SEQ ID NO: 10065652 - DNA, 22 bp, Homo sapiens
gagcagctgagctggaatgaga

SEQ ID NO: 10065653 - DNA, 22 bp, Homo sapiens
gagcagctcgagaaggaagcag

SEQ ID NO: 10065654 - DNA, 22 bp, Homo sapiens
gagctggggcagcttaggagtg

SEQ ID NO: 10065655 - DNA, 22 bp, Homo sapiens
gagttagaccactctgtctggt

SEQ ID NO: 10065656 - DNA, 22 bp, Homo sapiens
gagggcacgaaacaaccacttc

SEQ ID NO: 10065657 - DNA, 22 bp, Homo sapiens
gagggcaaaacagagaagatgt

SEQ ID NO: 10065658 - DNA, 22 bp, Homo sapiens
gcagaggctgggtgtcccagtc

SEQ ID NO: 10065659 - DNA, 18 bp, Homo sapiens
gcacagagcccaggctct

SEQ ID NO: 10065660 - DNA, 22 bp, Homo sapiens
gcacagagcctggtaccgagaa

SEQ ID NO: 10065661 - DNA, 22 bp, Homo sapiens
gcacagagcttgtttacatttg

SEQ ID NO: 10065662 - DNA, 22 bp, Homo sapiens
gcacagaggaagcacagactct

SEQ ID NO: 10065663 - DNA, 20 bp, Homo sapiens
gcagtgctggtgcctctgct

SEQ ID NO: 10065664 - DNA, 22 bp, Homo sapiens
gcagtgctgagaggtgatcgga

SEQ ID NO: 10065665 - DNA, 22 bp, Homo sapiens
gcaggctaactacaatcaaggg

SEQ ID NO: 10065666 - DNA, 22 bp, Homo sapiens
gcagggagggcctttcatgaca

SEQ ID NO: 10065667 - DNA, 22 bp, Homo sapiens
gcagggaggaagagatgcttcc

SEQ ID NO: 10065668 - DNA, 22 bp, Homo sapiens
gcaggctagggagctgcagtcc

SEQ ID NO: 10065669 - DNA, 22 bp, Homo sapiens
gcaggggttttctgacttgagt

SEQ ID NO: 10065670 - DNA, 22 bp, Homo sapiens
gcagggaggtttgctgacctgg

SEQ ID NO: 10065671 - DNA, 22 bp, Homo sapiens
gcaggggtagtgtcttcctgag

SEQ ID NO: 10065672 - DNA, 16 bp, Homo sapiens
gcaggggtgggtggag

SEQ ID NO: 10065673 - DNA, 22 bp, Homo sapiens
gcaggggtagagattgctggtg

SEQ ID NO: 10065674 - DNA, 22 bp, Homo sapiens
gcaggtggatcaccacgtcagg

SEQ ID NO: 10065675 - DNA, 22 bp, Homo sapiens
gcgtggggtaggtagacatgga

SEQ ID NO: 10065676 - DNA, 22 bp, Homo sapiens
gcgttggggaccccgaagctgg

SEQ ID NO: 10065677 - DNA, 22 bp, Homo sapiens
gctaagaattctgagcagctga

SEQ ID NO: 10065678 - DNA, 22 bp, Homo sapiens
gctcagggctaaggctgagggg

SEQ ID NO: 10065679 - DNA, 22 bp, Homo sapiens
gctcagggctaaggctgagggg

SEQ ID NO: 10065680 - DNA, 22 bp, Homo sapiens
gctcagggtcccttggtgctgg

SEQ ID NO: 10065681 - DNA, 22 bp, Homo sapiens
gctcaggtgttacctcctctag

SEQ ID NO: 10065682 - DNA, 22 bp, Homo sapiens
gctcagggtcccttggtgctgg

SEQ ID NO: 10065683 - DNA, 22 bp, Homo sapiens
gctccttctggctcccttttgg

SEQ ID NO: 10065684 - DNA, 20 bp, Homo sapiens
gctgactgtttgggtggcgg

SEQ ID NO: 10065685 - DNA, 22 bp, Homo sapiens
gccctcctgcaggggcttctgg

SEQ ID NO: 10065686 - DNA, 22 bp, Homo sapiens
gccctccatggtgatccaggcc

SEQ ID NO: 10065687 - DNA, 22 bp, Homo sapiens
gccctcccctctgggtggtgag

SEQ ID NO: 10065688 - DNA, 23 bp, Homo sapiens
gccctccctcccaggtgggtgtt

SEQ ID NO: 10065689 - DNA, 22 bp, Homo sapiens
gccctccctacagcctatttct

SEQ ID NO: 10065690 - DNA, 22 bp, Homo sapiens
gcccaggagttcaagtctagtg

SEQ ID NO: 10065691 - DNA, 22 bp, Homo sapiens
gcccctccatccatcaccgggg

SEQ ID NO: 10065692 - DNA, 22 bp, Homo sapiens
gccctccacctggtctctctgg

SEQ ID NO: 10065693 - DNA, 22 bp, Homo sapiens
gccctccatgagacacagtgta

SEQ ID NO: 10065694 - DNA, 22 bp, Homo sapiens
gcccagcaggggatggcagctc

SEQ ID NO: 10065695 - DNA, 22 bp, Homo sapiens
gcccagccacagtcactttcat

SEQ ID NO: 10065696 - DNA, 22 bp, Homo sapiens
gggctcaggcctggcctctcac

SEQ ID NO: 10065697 - DNA, 22 bp, Homo sapiens
gggctcaggagtttgaggctgc

SEQ ID NO: 10065698 - DNA, 22 bp, Homo sapiens
gggctcagtcctggttctaccc

SEQ ID NO: 10065699 - DNA, 22 bp, Homo sapiens
gggctcagggacacatgtgtgt

SEQ ID NO: 10065700 - DNA, 22 bp, Homo sapiens
gggctcaggtcagggcatcagc

SEQ ID NO: 10065701 - DNA, 22 bp, Homo sapiens
gggctcagtcggcaagcccctt

SEQ ID NO: 10065702 - DNA, 22 bp, Homo sapiens
gggctcagtctgcggcgcgcgg

SEQ ID NO: 10065703 - DNA, 21 bp, Homo sapiens
gggctcagtggaaaagagtgt

SEQ ID NO: 10065704 - DNA, 22 bp, Homo sapiens
gggctcagtctggcgtggaatg

SEQ ID NO: 10065705 - DNA, 22 bp, Homo sapiens
gggggagctagtccagctgagg

SEQ ID NO: 10065706 - DNA, 23 bp, Homo sapiens
gggggagctggactcctagatcc

SEQ ID NO: 10065707 - DNA, 22 bp, Homo sapiens
gggggagctgttattggcaggg

SEQ ID NO: 10065708 - DNA, 22 bp, Homo sapiens
cagagagagtctgtccctgaag

SEQ ID NO: 10065709 - DNA, 22 bp, Homo sapiens
cagagagagtggggtgtggatt

SEQ ID NO: 10065710 - DNA, 22 bp, Homo sapiens
cagagagcttagtgtgctgcat

SEQ ID NO: 10065711 - DNA, 22 bp, Homo sapiens
cagagcagcagagcttccatgg

SEQ ID NO: 10065712 - DNA, 22 bp, Homo sapiens
cagagcagcctccagggggagc

SEQ ID NO: 10065713 - DNA, 22 bp, Homo sapiens
cagagcagcctccagggggagc

SEQ ID NO: 10065714 - DNA, 22 bp, Homo sapiens
cagagcaggaatagggtgttga

SEQ ID NO: 10065715 - DNA, 18 bp, Homo sapiens
cagagcagaggtggagcg

SEQ ID NO: 10065716 - DNA, 18 bp, Homo sapiens
cagagcagaggtggagcg

SEQ ID NO: 10065717 - DNA, 22 bp, Homo sapiens
cagagagagcaggaaacctccg

SEQ ID NO: 10065718 - DNA, 19 bp, Homo sapiens
cagagagaccaaggcgcca

SEQ ID NO: 10065719 - DNA, 22 bp, Homo sapiens
cagagagaatcttggcagctga

SEQ ID NO: 10065720 - DNA, 22 bp, Homo sapiens
cagagagaggccactgctatta

SEQ ID NO: 10065721 - DNA, 22 bp, Homo sapiens
cagagagaggggctgcctggcc

SEQ ID NO: 10065722 - DNA, 22 bp, Homo sapiens
cagagagagtcaaatctttgct

SEQ ID NO: 10065723 - DNA, 22 bp, Homo sapiens
cagagagaggtgccgataatgg

SEQ ID NO: 10065724 - DNA, 22 bp, Homo sapiens
cagagagaatatgtagtatgga

SEQ ID NO: 10065725 - DNA, 22 bp, Homo sapiens
cagagacagtttcacagggtct

SEQ ID NO: 10065726 - DNA, 20 bp, Homo sapiens
cagaagcaaggcaggtacct

SEQ ID NO: 10065727 - DNA, 22 bp, Homo sapiens
ggtgctggttcagggtggctgt

SEQ ID NO: 10065728 - DNA, 20 bp, Homo sapiens
cagcagagacccatggggag

SEQ ID NO: 10065729 - DNA, 22 bp, Homo sapiens
gtaactggttttcttccctctc

SEQ ID NO: 10065730 - DNA, 22 bp, Homo sapiens
ggtgcaaagggcctagagagtg

SEQ ID NO: 10065731 - DNA, 22 bp, Homo sapiens
ggtgcaaaagtagttctgcttt

SEQ ID NO: 10065732 - DNA, 22 bp, Homo sapiens
ggtgcaaagatggcagttgcaa

SEQ ID NO: 10065733 - DNA, 22 bp, Homo sapiens
ggggtctgctgcggagcagaga

SEQ ID NO: 10065734 - DNA, 22 bp, Homo sapiens
cagcagggttaagtgactcacc

SEQ ID NO: 10065735 - DNA, 20 bp, Homo sapiens
cagcagtggatgagagtttt

SEQ ID NO: 10065736 - DNA, 22 bp, Homo sapiens
cagcagtgatgtgtgagggttc

SEQ ID NO: 10065737 - DNA, 23 bp, Homo sapiens
gtgcaaagatataccacatggct

SEQ ID NO: 10065738 - DNA, 23 bp, Homo sapiens
gtgcagcagtgtctgcagtcatg

SEQ ID NO: 10065739 - DNA, 22 bp, Homo sapiens
gtctcagggctgagggcagtgg

SEQ ID NO: 10065740 - DNA, 22 bp, Homo sapiens
cagctcccagaactgaccatgt

SEQ ID NO: 10065741 - DNA, 20 bp, Homo sapiens
cagcctccactcactcagct

SEQ ID NO: 10065742 - DNA, 22 bp, Homo sapiens
caatgggagcagaaattgtttg

SEQ ID NO: 10065743 - DNA, 22 bp, Homo sapiens
caatggctttatgtatcatctc

SEQ ID NO: 10065744 - DNA, 22 bp, Homo sapiens
caatggtggtgtcagaagagat

SEQ ID NO: 10065745 - DNA, 22 bp, Homo sapiens
gctggtgtgtgaacctagggac

SEQ ID NO: 10065746 - DNA, 22 bp, Homo sapiens
gctggtgtctaacctggctctt

SEQ ID NO: 10065747 - DNA, 22 bp, Homo sapiens
gctggtggtaaggaggaaaaag

SEQ ID NO: 10065748 - DNA, 20 bp, Homo sapiens
gctggtgggggcttgacatg

SEQ ID NO: 10065749 - DNA, 19 bp, Homo sapiens
gctgggagcagaccctccc

SEQ ID NO: 10065750 - DNA, 22 bp, Homo sapiens
gctgggagccctggtctgctcc

SEQ ID NO: 10065751 - DNA, 19 bp, Homo sapiens
cacagctctgctcagggaa

SEQ ID NO: 10065752 - DNA, 22 bp, Homo sapiens
ggagcagccacgtctcagggca

SEQ ID NO: 10065753 - DNA, 22 bp, Homo sapiens
ggagcagcactgccacacagag

SEQ ID NO: 10065754 - DNA, 22 bp, Homo sapiens
ggagcagccgcgtctcagggca

SEQ ID NO: 10065755 - DNA, 22 bp, Homo sapiens
ggagcagcttgcatgctcaggg

SEQ ID NO: 10065756 - DNA, 22 bp, Homo sapiens
ggaggactgagacactcctggc

SEQ ID NO: 10065757 - DNA, 22 bp, Homo sapiens
ggaggagcacttctgagctcag

SEQ ID NO: 10065758 - DNA, 22 bp, Homo sapiens
ggagagctgacatcatgatgtt

SEQ ID NO: 10065759 - DNA, 22 bp, Homo sapiens
ggacagcattctactgtaggca

SEQ ID NO: 10065760 - DNA, 22 bp, Homo sapiens
cacagcaaagacactctcaact

SEQ ID NO: 10065761 - DNA, 22 bp, Homo sapiens
ggaaggggccttgagcaaactg

SEQ ID NO: 10065762 - DNA, 22 bp, Homo sapiens
ggacaaagcctggtggcaggtg

SEQ ID NO: 10065763 - DNA, 22 bp, Homo sapiens
ggacagcacagctcttgacaac

SEQ ID NO: 10065764 - DNA, 23 bp, Homo sapiens
ggacacagagataagtgagacaa

SEQ ID NO: 10065765 - DNA, 22 bp, Homo sapiens
ggaacaggaaaggagggatgct

SEQ ID NO: 10065766 - DNA, 22 bp, Homo sapiens
cacccaggaggttgggaagggc

SEQ ID NO: 10065767 - DNA, 22 bp, Homo sapiens
cacccaggcaggtggctgagaa

SEQ ID NO: 10065768 - DNA, 22 bp, Homo sapiens
cacccaggcatgggttgagatg

SEQ ID NO: 10065769 - DNA, 22 bp, Homo sapiens
ggagtctgctcccagacatgat

SEQ ID NO: 10065770 - DNA, 22 bp, Homo sapiens
ggagtctgggaattggagagaa

SEQ ID NO: 10065771 - DNA, 22 bp, Homo sapiens
ggatcaggcgccatgggaagtg

SEQ ID NO: 10065772 - DNA, 22 bp, Homo sapiens
ggatcaagtgcactctgaacac

SEQ ID NO: 10065773 - DNA, 22 bp, Homo sapiens
ggataaagtctttaggtggaca

SEQ ID NO: 10065774 - DNA, 22 bp, Homo sapiens
ggcaggtgccttctgtgctagc

SEQ ID NO: 10065775 - DNA, 22 bp, Homo sapiens
ggcaggtgtgagctgtaaagga

SEQ ID NO: 10065776 - DNA, 22 bp, Homo sapiens
cagaaatgtgatgtacacacac

SEQ ID NO: 10065777 - DNA, 22 bp, Homo sapiens
cagaacagtacctagcacatag

SEQ ID NO: 10065778 - DNA, 22 bp, Homo sapiens
cagaacagtacctagcacatag

SEQ ID NO: 10065779 - DNA, 22 bp, Homo sapiens
cagaacagggcccaaggggtcg

SEQ ID NO: 10065780 - DNA, 19 bp, Homo sapiens
cagaacagaggtcatggcc

SEQ ID NO: 10065781 - DNA, 22 bp, Homo sapiens
aggctgggcaccgttttgatcc

SEQ ID NO: 10065782 - DNA, 20 bp, Homo sapiens
aggctggggtgttttgccca

SEQ ID NO: 10065783 - DNA, 20 bp, Homo sapiens
ccagggctggctcctgggat

SEQ ID NO: 10065784 - DNA, 22 bp, Homo sapiens
ccagggcaggagaaagactcac

SEQ ID NO: 10065785 - DNA, 21 bp, Homo sapiens
ccagagcctgctgagccccct

SEQ ID NO: 10065786 - DNA, 22 bp, Homo sapiens
aggccagtgcagctggaacaga

SEQ ID NO: 10065787 - DNA, 22 bp, Homo sapiens
ccagctggcccagctgtgctcc

SEQ ID NO: 10065788 - DNA, 22 bp, Homo sapiens
ccagctggcactgtggctgccc

SEQ ID NO: 10065789 - DNA, 22 bp, Homo sapiens
ccagctctgccaagcgtcagct

SEQ ID NO: 10065790 - DNA, 22 bp, Homo sapiens
agggctggagccacagctggga

SEQ ID NO: 10065791 - DNA, 22 bp, Homo sapiens
agggcctggaactgtgggcagg

SEQ ID NO: 10065792 - DNA, 20 bp, Homo sapiens
agggcctggagtacagcagg

SEQ ID NO: 10065793 - DNA, 22 bp, Homo sapiens
ccctggaactcctaggcaagca

SEQ ID NO: 10065794 - DNA, 22 bp, Homo sapiens
ccctggaacccatggccagtgt

SEQ ID NO: 10065795 - DNA, 22 bp, Homo sapiens
cctcttccactgggccccatcc

SEQ ID NO: 10065796 - DNA, 22 bp, Homo sapiens
cccaggctgtgcaaacttcaaa

SEQ ID NO: 10065797 - DNA, 22 bp, Homo sapiens
cccatcaggaacccaggagccc

SEQ ID NO: 10065798 - DNA, 22 bp, Homo sapiens
cccaggaatgaggggcggaggc

SEQ ID NO: 10065799 - DNA, 22 bp, Homo sapiens
ccctcccagatgggcttgaggt

SEQ ID NO: 10065800 - DNA, 22 bp, Homo sapiens
ccctcccaggagtggccagaga

SEQ ID NO: 10065801 - DNA, 22 bp, Homo sapiens
ccctcccaagcactctgacata

SEQ ID NO: 10065802 - DNA, 22 bp, Homo sapiens
ccctccattaaaacagacctat

SEQ ID NO: 10065803 - DNA, 22 bp, Homo sapiens
caggtccctgcgccccggcctc

SEQ ID NO: 10065804 - DNA, 22 bp, Homo sapiens
cagggttgggctccaaggatgg

SEQ ID NO: 10065805 - DNA, 22 bp, Homo sapiens
aggaagaggtagctgtcaaggg

SEQ ID NO: 10065806 - DNA, 22 bp, Homo sapiens
cagggactgagatccagactgt

SEQ ID NO: 10065807 - DNA, 22 bp, Homo sapiens
cagggaccctactagctcacac

SEQ ID NO: 10065808 - DNA, 22 bp, Homo sapiens
cagggacattggtggccaggtt

SEQ ID NO: 10065809 - DNA, 22 bp, Homo sapiens
aggaaaagtgtgaagtatggag

SEQ ID NO: 10065810 - DNA, 20 bp, Homo sapiens
aggaaaagggtggtggtaga

SEQ ID NO: 10065811 - DNA, 22 bp, Homo sapiens
agctgggcagactgcagtggtt

SEQ ID NO: 10065812 - DNA, 22 bp, Homo sapiens
agctgggctccaagagggatct

SEQ ID NO: 10065813 - DNA, 22 bp, Homo sapiens
agctgggcctgagctggaagct

SEQ ID NO: 10065814 - DNA, 22 bp, Homo sapiens
agctgggcctgatttgcagggg

SEQ ID NO: 10065815 - DNA, 22 bp, Homo sapiens
agctggagattctggggacagt

SEQ ID NO: 10065816 - DNA, 19 bp, Homo sapiens
agctggagattggagggca

SEQ ID NO: 10065817 - DNA, 22 bp, Homo sapiens
agctggagccagtgtgaggctt

SEQ ID NO: 10065818 - DNA, 22 bp, Homo sapiens
agctggagcttcaagcaggtaa

SEQ ID NO: 10065819 - DNA, 22 bp, Homo sapiens
agctggagaaacctgggagggt

SEQ ID NO: 10065820 - DNA, 22 bp, Homo sapiens
agctggagagtttccaggaagg

SEQ ID NO: 10065821 - DNA, 22 bp, Homo sapiens
agctgggtgtagggctggacaa

SEQ ID NO: 10065822 - DNA, 19 bp, Homo sapiens
agctgggtgttagtggaga

SEQ ID NO: 10065823 - DNA, 21 bp, Homo sapiens
agctgggtgggctgagtgaca

SEQ ID NO: 10065824 - DNA, 22 bp, Homo sapiens
aggagccaatctgataaagcca

SEQ ID NO: 10065825 - DNA, 22 bp, Homo sapiens
aggagccaaacatattgagaga

SEQ ID NO: 10065826 - DNA, 22 bp, Homo sapiens
aggagccaaaagctgaacaaga

SEQ ID NO: 10065827 - DNA, 22 bp, Homo sapiens
aggagctggcctagaaaggaga

SEQ ID NO: 10065828 - DNA, 22 bp, Homo sapiens
aggagctgggctgctgctggga

SEQ ID NO: 10065829 - DNA, 23 bp, Homo sapiens
cagtgcagggcaactcagactcc

SEQ ID NO: 10065830 - DNA, 21 bp, Homo sapiens
cagtgaggccctcctgttccc

SEQ ID NO: 10065831 - DNA, 22 bp, Homo sapiens
aggagtggaattactgggttct

SEQ ID NO: 10065832 - DNA, 22 bp, Homo sapiens
aggagggtggcctcatgtgagt

SEQ ID NO: 10065833 - DNA, 22 bp, Homo sapiens
catcagaagaaagacaaatgat

SEQ ID NO: 10065834 - DNA, 22 bp, Homo sapiens
catcagaacgtgagctccttgt

SEQ ID NO: 10065835 - DNA, 22 bp, Homo sapiens
catcagaaccagtggggacatt

SEQ ID NO: 10065836 - DNA, 22 bp, Homo sapiens
catcagaatagctctgtggata

SEQ ID NO: 10065837 - DNA, 22 bp, Homo sapiens
catcagaaggccagagggtagc

SEQ ID NO: 10065838 - DNA, 22 bp, Homo sapiens
catcagaatgaatgttctggag

SEQ ID NO: 10065839 - DNA, 22 bp, Homo sapiens
catcagaatctgagtctctgcc

SEQ ID NO: 10065840 - DNA, 22 bp, Homo sapiens
catcagaagatggctctggaaa

SEQ ID NO: 10065841 - DNA, 22 bp, Homo sapiens
catcagaaggaaggacgattat

SEQ ID NO: 10065842 - DNA, 20 bp, Homo sapiens
catcagaaatcctgacccac

SEQ ID NO: 10065843 - DNA, 22 bp, Homo sapiens
catcagaaccagctgggtgagg

SEQ ID NO: 10065844 - DNA, 22 bp, Homo sapiens
catcagaacaaatcggttaaga

SEQ ID NO: 10065845 - DNA, 22 bp, Homo sapiens
catcagaaaccttgaggaaact

SEQ ID NO: 10065846 - DNA, 22 bp, Homo sapiens
catcagaaagagtcctggactt

SEQ ID NO: 10065847 - DNA, 22 bp, Homo sapiens
catcagaattacttggggagct

SEQ ID NO: 10065848 - DNA, 22 bp, Homo sapiens
catcagaatgttatggggggct

SEQ ID NO: 10065849 - DNA, 22 bp, Homo sapiens
catcagaatgttagagaaggga

SEQ ID NO: 10065850 - DNA, 22 bp, Homo sapiens
aggcactgaaaggtggccagag

SEQ ID NO: 10065851 - DNA, 22 bp, Homo sapiens
aggcacaggtggacttcacagt

SEQ ID NO: 10065852 - DNA, 23 bp, Homo sapiens
aggcactgaatgtgtcagtgagt

SEQ ID NO: 10065853 - DNA, 22 bp, Homo sapiens
aggcactgactcaagggagcca

SEQ ID NO: 10065854 - DNA, 22 bp, Homo sapiens
aggcagaggaagggtggatttg

SEQ ID NO: 10065855 - DNA, 22 bp, Homo sapiens
aggcagagctgatgttctgtga

SEQ ID NO: 10065856 - DNA, 20 bp, Homo sapiens
aggcagctggccaggcaggt

SEQ ID NO: 10065857 - DNA, 22 bp, Homo sapiens
ccaaagcaagtcacatgatcaa

SEQ ID NO: 10065858 - DNA, 22 bp, Homo sapiens
aggcaggccgtgtccctcctca

SEQ ID NO: 10065859 - DNA, 22 bp, Homo sapiens
aggcaggctcaggcccatgctt

SEQ ID NO: 10065860 - DNA, 22 bp, Homo sapiens
ctgctgccattagggcacagac

SEQ ID NO: 10065861 - DNA, 22 bp, Homo sapiens
ctgctgtggtgtcaagcatctc

SEQ ID NO: 10065862 - DNA, 22 bp, Homo sapiens
ctgctgtgccttaaaatgcaag

SEQ ID NO: 10065863 - DNA, 22 bp, Homo sapiens
ctggcctaaaaatacagaacaa

SEQ ID NO: 10065864 - DNA, 22 bp, Homo sapiens
ctgggaggcggaggttgcagtg

SEQ ID NO: 10065865 - DNA, 22 bp, Homo sapiens
atcacagacaattgtcagacca

SEQ ID NO: 10065866 - DNA, 23 bp, Homo sapiens
ctgtctcctgggctaggtggaat

SEQ ID NO: 10065867 - DNA, 22 bp, Homo sapiens
atcataattgctccagtgatat

SEQ ID NO: 10065868 - DNA, 22 bp, Homo sapiens
atctccttggtctcgttccagg

SEQ ID NO: 10065869 - DNA, 19 bp, Homo sapiens
atctcctttcttcaagctt

SEQ ID NO: 10065870 - DNA, 22 bp, Homo sapiens
atctccttggatcacgtttagt

SEQ ID NO: 10065871 - DNA, 22 bp, Homo sapiens
cttctccttatatgtcccgttc

SEQ ID NO: 10065872 - DNA, 22 bp, Homo sapiens
cttctgtgcgcctctattccct

SEQ ID NO: 10065873 - DNA, 22 bp, Homo sapiens
cttctgtggatatgttctctct

SEQ ID NO: 10065874 - DNA, 22 bp, Homo sapiens
agtgtcagcctgggcaaggaac

SEQ ID NO: 10065875 - DNA, 17 bp, Homo sapiens
agtgtcagaagacagtt

SEQ ID NO: 10065876 - DNA, 19 bp, Homo sapiens
agtggtagatgagcaggag

SEQ ID NO: 10065877 - DNA, 20 bp, Homo sapiens
agtgtgcatttagagtctgc

SEQ ID NO: 10065878 - DNA, 22 bp, Homo sapiens
ctgagcagccccaccagccatt

SEQ ID NO: 10065879 - DNA, 22 bp, Homo sapiens
agtggacaaccatgctgagatt

SEQ ID NO: 10065880 - DNA, 22 bp, Homo sapiens
agtggacaaccatgctgagatt

SEQ ID NO: 10065881 - DNA, 22 bp, Homo sapiens
agtggcagggacttcatataaa

SEQ ID NO: 10065882 - DNA, 20 bp, Homo sapiens
agtggcagggaaatggaaag

SEQ ID NO: 10065883 - DNA, 22 bp, Homo sapiens
agtgcgcaaaaatagaagctgt

SEQ ID NO: 10065884 - DNA, 22 bp, Homo sapiens
ccttctcccctctgcagggtgt

SEQ ID NO: 10065885 - DNA, 21 bp, Homo sapiens
ccttctccattacagtaagct

SEQ ID NO: 10065886 - DNA, 22 bp, Homo sapiens
ccttctcctgccttgggttcat

SEQ ID NO: 10065887 - DNA, 22 bp, Homo sapiens
agtaggaggcgggagcatgaag

SEQ ID NO: 10065888 - DNA, 22 bp, Homo sapiens
agtcacagttagactacccaag

SEQ ID NO: 10065889 - DNA, 22 bp, Homo sapiens
agtcagcagtgaaagcacagcc

SEQ ID NO: 10065890 - DNA, 22 bp, Homo sapiens
cctgtgggccaaggacctgcca

SEQ ID NO: 10065891 - DNA, 22 bp, Homo sapiens
cctgtgggagggagcggctgga

SEQ ID NO: 10065892 - DNA, 22 bp, Homo sapiens
cctgtgggaggggcctggcgcg

SEQ ID NO: 10065893 - DNA, 22 bp, Homo sapiens
aggtcaccatggcatgctccac

SEQ ID NO: 10065894 - DNA, 22 bp, Homo sapiens
aggtaatgcatataaagtgctt

SEQ ID NO: 10065895 - DNA, 22 bp, Homo sapiens
agctgggaggtgggcagtgaga

SEQ ID NO: 10065896 - DNA, 22 bp, Homo sapiens
agctgtggttctgggcagcgac

SEQ ID NO: 10065897 - DNA, 22 bp, Homo sapiens
acagccagtaatctacccctgt

SEQ ID NO: 10065898 - DNA, 22 bp, Homo sapiens
acagccaggtaaaggcatggca

SEQ ID NO: 10065899 - DNA, 22 bp, Homo sapiens
agctccaggtgcaagtcatggt

SEQ ID NO: 10065900 - DNA, 22 bp, Homo sapiens
acagcccaggactccagtgggc

SEQ ID NO: 10065901 - DNA, 20 bp, Homo sapiens
aggagccattgactgcagca

SEQ ID NO: 10065902 - DNA, 23 bp, Homo sapiens
aggagccatgagttggatatgtt

SEQ ID NO: 10065903 - DNA, 22 bp, Homo sapiens
acaggggctccgaaggtgaggg

SEQ ID NO: 10065904 - DNA, 22 bp, Homo sapiens
aggagctgatgattctttgatc

SEQ ID NO: 10065905 - DNA, 22 bp, Homo sapiens
aggagctgcttaaatggttggt

SEQ ID NO: 10065906 - DNA, 22 bp, Homo sapiens
aggcacagaatggcattcagtg

SEQ ID NO: 10065907 - DNA, 21 bp, Homo sapiens
aggaggggtctttcccactga

SEQ ID NO: 10065908 - DNA, 22 bp, Homo sapiens
aggagggagatgcccatcctgg

SEQ ID NO: 10065909 - DNA, 22 bp, Homo sapiens
accaggtggccccagcgtggtt

SEQ ID NO: 10065910 - DNA, 22 bp, Homo sapiens
accaggaatattttgctcattt

SEQ ID NO: 10065911 - DNA, 19 bp, Homo sapiens
accaggaacttccctaggc

SEQ ID NO: 10065912 - DNA, 22 bp, Homo sapiens
accaggaagaacaggcaaggca

SEQ ID NO: 10065913 - DNA, 22 bp, Homo sapiens
accaggaacaagccatggagga

SEQ ID NO: 10065914 - DNA, 22 bp, Homo sapiens
accaggaactcacccgcagagg

SEQ ID NO: 10065915 - DNA, 22 bp, Homo sapiens
accctgggagggagaaatcaga

SEQ ID NO: 10065916 - DNA, 22 bp, Homo sapiens
acccagggttcctgggtcccag

SEQ ID NO: 10065917 - DNA, 22 bp, Homo sapiens
acccagggtttgagctctgcag

SEQ ID NO: 10065918 - DNA, 22 bp, Homo sapiens
acccagggaccccgctgacgcc

SEQ ID NO: 10065919 - DNA, 22 bp, Homo sapiens
aggcccagcttgaagtgggaag

SEQ ID NO: 10065920 - DNA, 22 bp, Homo sapiens
aggccagcattctctctccagg

SEQ ID NO: 10065921 - DNA, 23 bp, Homo sapiens
actgagcaatgtttacatacttg

SEQ ID NO: 10065922 - DNA, 22 bp, Homo sapiens
actgagcaagtgctgctcacgt

SEQ ID NO: 10065923 - DNA, 22 bp, Homo sapiens
actgagcatggctcacagagag

SEQ ID NO: 10065924 - DNA, 22 bp, Homo sapiens
agtgctcctttcattgctgccc

SEQ ID NO: 10065925 - DNA, 22 bp, Homo sapiens
actgcacatagtgggctggcct

SEQ ID NO: 10065926 - DNA, 22 bp, Homo sapiens
actgcccttgtcctggcacacc

SEQ ID NO: 10065927 - DNA, 22 bp, Homo sapiens
actctcccttggagcctcaggc

SEQ ID NO: 10065928 - DNA, 22 bp, Homo sapiens
actctccttttgatcttcagaa

SEQ ID NO: 10065929 - DNA, 22 bp, Homo sapiens
actcctgggtgctgaccagcgt

SEQ ID NO: 10065930 - DNA, 22 bp, Homo sapiens
agtcaccttgaaatgtcttgaa

SEQ ID NO: 10065931 - DNA, 21 bp, Homo sapiens
acctttggaaagaccctggga

SEQ ID NO: 10065932 - DNA, 22 bp, Homo sapiens
acctttggaggactagggtcat

SEQ ID NO: 10065933 - DNA, 22 bp, Homo sapiens
actactgatgtaaaggagcaat

SEQ ID NO: 10065934 - DNA, 22 bp, Homo sapiens
aggtgactggtttatctggcag

SEQ ID NO: 10065935 - DNA, 22 bp, Homo sapiens
acctttggataatctttgtgtt

SEQ ID NO: 10065936 - DNA, 22 bp, Homo sapiens
acctttggataatttgagtttg

SEQ ID NO: 10065937 - DNA, 22 bp, Homo sapiens
aggtgacaggacaggagctggt

SEQ ID NO: 10065938 - DNA, 22 bp, Homo sapiens
agaagccaacagggcaggagag

SEQ ID NO: 10065939 - DNA, 22 bp, Homo sapiens
agaaggcactcacactggcacg

SEQ ID NO: 10065940 - DNA, 22 bp, Homo sapiens
agaaggcaggttttaaaatgtc

SEQ ID NO: 10065941 - DNA, 20 bp, Homo sapiens
agaaggcaggagacaaaagg

SEQ ID NO: 10065942 - DNA, 22 bp, Homo sapiens
agaaggcagatgggacggagca

SEQ ID NO: 10065943 - DNA, 21 bp, Homo sapiens
agaaggcaaaagcagacatct

SEQ ID NO: 10065944 - DNA, 22 bp, Homo sapiens
agaaggcacagtgctgctaaga

SEQ ID NO: 10065945 - DNA, 22 bp, Homo sapiens
agaacaggttcagggtataaaa

SEQ ID NO: 10065946 - DNA, 22 bp, Homo sapiens
agaacagggactggaggcttca

SEQ ID NO: 10065947 - DNA, 22 bp, Homo sapiens
agaacatggattgtcaaaggta

SEQ ID NO: 10065948 - DNA, 22 bp, Homo sapiens
atcccaggaggctgcgcagtta

SEQ ID NO: 10065949 - DNA, 22 bp, Homo sapiens
atcccaggggttgtatcttccc

SEQ ID NO: 10065950 - DNA, 22 bp, Homo sapiens
atcccaggcggcacaggttgca

SEQ ID NO: 10065951 - DNA, 22 bp, Homo sapiens
atccaggcattctgacttcaag

SEQ ID NO: 10065952 - DNA, 16 bp, Homo sapiens
atccaggcaggaaaga

SEQ ID NO: 10065953 - DNA, 22 bp, Homo sapiens
atctgcctggctccaggtgagc

SEQ ID NO: 10065954 - DNA, 22 bp, Homo sapiens
atctgcctgcttatgatgcctg

SEQ ID NO: 10065955 - DNA, 22 bp, Homo sapiens
atctgcctgtatttaccatcat

SEQ ID NO: 10065956 - DNA, 22 bp, Homo sapiens
atctgcctggtctttgatgcag

SEQ ID NO: 10065957 - DNA, 22 bp, Homo sapiens
atctgcctgcagtggaggtggg

SEQ ID NO: 10065958 - DNA, 22 bp, Homo sapiens
atctgcctgagtctaggttttc

SEQ ID NO: 10065959 - DNA, 22 bp, Homo sapiens
atctgcctcttcttcattgcga

SEQ ID NO: 10065960 - DNA, 22 bp, Homo sapiens
atctgcctccaagtccatgtgt

SEQ ID NO: 10065961 - DNA, 19 bp, Homo sapiens
atctgccttagtgctgctg

SEQ ID NO: 10065962 - DNA, 19 bp, Homo sapiens
atctgcctgttatcacata

SEQ ID NO: 10065963 - DNA, 22 bp, Homo sapiens
agactggggttctggcaaggag

SEQ ID NO: 10065964 - DNA, 22 bp, Homo sapiens
agacccagagggctgctgggag

SEQ ID NO: 10065965 - DNA, 22 bp, Homo sapiens
agagccaggccaggccggggca

SEQ ID NO: 10065966 - DNA, 22 bp, Homo sapiens
agagcccaggtcctggagaggg

SEQ ID NO: 10065967 - DNA, 22 bp, Homo sapiens
agagcccatcagtggcagtgga

SEQ ID NO: 10065968 - DNA, 22 bp, Homo sapiens
agagcagatggccagggggcct

SEQ ID NO: 10065969 - DNA, 22 bp, Homo sapiens
agagcagcacgttgtccccaca

SEQ ID NO: 10065970 - DNA, 20 bp, Homo sapiens
agagcagcagttggtgaggt

SEQ ID NO: 10065971 - DNA, 22 bp, Homo sapiens
agagcagatggagctggaagag

SEQ ID NO: 10065972 - DNA, 22 bp, Homo sapiens
agagcacaggctctggagtcta

SEQ ID NO: 10065973 - DNA, 22 bp, Homo sapiens
agagcacaggtgctggagccca

SEQ ID NO: 10065974 - DNA, 22 bp, Homo sapiens
agagcactgagtgagcaaggcc

SEQ ID NO: 10065975 - DNA, 22 bp, Homo sapiens
agagcaccccgggaagagcaag

SEQ ID NO: 10065976 - DNA, 22 bp, Homo sapiens
agagcagaggcatggccgtggg

SEQ ID NO: 10065977 - DNA, 22 bp, Homo sapiens
agagaaggggtaaagagtcctg

SEQ ID NO: 10065978 - DNA, 22 bp, Homo sapiens
agagaaggaaagctgacatggg

SEQ ID NO: 10065979 - DNA, 22 bp, Homo sapiens
agacttgggacctaggaatgga

SEQ ID NO: 10065980 - DNA, 22 bp, Homo sapiens
agagagcatggcacagaggggt

SEQ ID NO: 10065981 - DNA, 22 bp, Homo sapiens
agagaggcgagttacctgtgct

SEQ ID NO: 10065982 - DNA, 22 bp, Homo sapiens
agaggctccttcactctggcac

SEQ ID NO: 10065983 - DNA, 22 bp, Homo sapiens
agaggggctcaagcagtggtct

SEQ ID NO: 10065984 - DNA, 23 bp, Homo sapiens
agaggggagcatctgctggctga

SEQ ID NO: 10065985 - DNA, 22 bp, Homo sapiens
agcaacagtgtatatcataggc

SEQ ID NO: 10065986 - DNA, 22 bp, Homo sapiens
caaaggcaggtgctgaatattc

SEQ ID NO: 10065987 - DNA, 21 bp, Homo sapiens
agatgctgtgctccaggagca

SEQ ID NO: 10065988 - DNA, 22 bp, Homo sapiens
agatgctgtgtctgttcccttg

SEQ ID NO: 10065989 - DNA, 22 bp, Homo sapiens
agatgctggatggaaaatgatc

SEQ ID NO: 10065990 - DNA, 22 bp, Homo sapiens
agatgctgtgaggaagctagga

SEQ ID NO: 10065991 - DNA, 18 bp, Homo sapiens
attggtcctgtccaccca

SEQ ID NO: 10065992 - DNA, 22 bp, Homo sapiens
attggtccatttaccctctctt

SEQ ID NO: 10065993 - DNA, 22 bp, Homo sapiens
attggtcccctcctatgtgcca

SEQ ID NO: 10065994 - DNA, 22 bp, Homo sapiens
agcagcctgcagatattggtct

SEQ ID NO: 10065995 - DNA, 22 bp, Homo sapiens
agcagcctggtctctcgccaat

SEQ ID NO: 10065996 - DNA, 22 bp, Homo sapiens
agcagccttgtgactccggggt

SEQ ID NO: 10065997 - DNA, 19 bp, Homo sapiens
agcagcagaagtgtgcctt

SEQ ID NO: 10065998 - DNA, 17 bp, Homo sapiens
agcagctggcacaggag

SEQ ID NO: 10065999 - DNA, 22 bp, Homo sapiens
cacagagcaggtgctgggaaga

SEQ ID NO: 10066000 - DNA, 22 bp, Homo sapiens
cacagagcaggggtctgtgtca

SEQ ID NO: 10066001 - DNA, 22 bp, Homo sapiens
cacagagcaactcaaatcagct

SEQ ID NO: 10066002 - DNA, 22 bp, Homo sapiens
agcagctagacttcagaatctg

SEQ ID NO: 10066003 - DNA, 22 bp, Homo sapiens
agcactgctttagagcctctgc

SEQ ID NO: 10066004 - DNA, 22 bp, Homo sapiens
agcaccttgctcttggccttcc

SEQ ID NO: 10066005 - DNA, 22 bp, Homo sapiens
agcacctgtggctcatgctcgt

SEQ ID NO: 10066006 - DNA, 22 bp, Homo sapiens
caaaggcatgtgagtatatgtg

SEQ ID NO: 10066007 - DNA, 22 bp, Homo sapiens
caaaggcagttactgaatgaag

SEQ ID NO: 10066008 - DNA, 22 bp, Homo sapiens
agcagagcgcctgctcagaggg

SEQ ID NO: 10066009 - DNA, 22 bp, Homo sapiens
agcagagcggggcctccggaag

SEQ ID NO: 10066010 - DNA, 22 bp, Homo sapiens
agcagagcctgggctaggggtg

SEQ ID NO: 10066011 - DNA, 22 bp, Homo sapiens
agcaggacacgatgcggcagga

SEQ ID NO: 10066012 - DNA, 22 bp, Homo sapiens
cacagcaatagctaactgatac

SEQ ID NO: 10066013 - DNA, 22 bp, Homo sapiens
agcagggaggcggtgtgctggc

SEQ ID NO: 10066014 - DNA, 22 bp, Homo sapiens
agcaggcttggtccccagcctc

SEQ ID NO: 10066015 - DNA, 22 bp, Homo sapiens
agcagggaggcccagggcactg

SEQ ID NO: 10066016 - DNA, 18 bp, Homo sapiens
agcatcactgatcatcct

SEQ ID NO: 10066017 - DNA, 22 bp, Homo sapiens
agccaggccagactcacaccct

SEQ ID NO: 10066018 - DNA, 20 bp, Homo sapiens
cagagaccaggccaggtgtc

SEQ ID NO: 10066019 - DNA, 22 bp, Homo sapiens
cagagccttagttctcctagaa

SEQ ID NO: 10066020 - DNA, 20 bp, Homo sapiens
cagagcccactttcttatca

SEQ ID NO: 10066021 - DNA, 21 bp, Homo sapiens
cagagcctgtgttgacagttg

SEQ ID NO: 10066022 - DNA, 22 bp, Homo sapiens
agccagcacggcgccatggagt

SEQ ID NO: 10066023 - DNA, 22 bp, Homo sapiens
agccagcactttttctctgggc

SEQ ID NO: 10066024 - DNA, 21 bp, Homo sapiens
agccagcaacacagcatctcc

SEQ ID NO: 10066025 - DNA, 22 bp, Homo sapiens
agccagcacggatttcccagga

SEQ ID NO: 10066026 - DNA, 22 bp, Homo sapiens
agccagcatcttgcttcttgag

SEQ ID NO: 10066027 - DNA, 22 bp, Homo sapiens
agccagcatcccttcagtctcc

SEQ ID NO: 10066028 - DNA, 22 bp, Homo sapiens
agccagcatgaagacagaggcc

SEQ ID NO: 10066029 - DNA, 22 bp, Homo sapiens
agccagcaggaacgtctaggtt

SEQ ID NO: 10066030 - DNA, 19 bp, Homo sapiens
agccagcagcgtagcatct

SEQ ID NO: 10066031 - DNA, 19 bp, Homo sapiens
agccagcaggcctctgagc

SEQ ID NO: 10066032 - DNA, 22 bp, Homo sapiens
agccagcagggcttagaggaca

SEQ ID NO: 10066033 - DNA, 22 bp, Homo sapiens
agccagcaggtgagtgcagcct

SEQ ID NO: 10066034 - DNA, 22 bp, Homo sapiens
agccagcatatatatagttgaa

SEQ ID NO: 10066035 - DNA, 22 bp, Homo sapiens
agccagcaggtgggaaactgga

SEQ ID NO: 10066036 - DNA, 17 bp, Homo sapiens
agccagcagtagctggt

SEQ ID NO: 10066037 - DNA, 22 bp, Homo sapiens
agccagcaggtgcagaattcca

SEQ ID NO: 10066038 - DNA, 22 bp, Homo sapiens
agccctggcccggctgtgcttt

SEQ ID NO: 10066039 - DNA, 22 bp, Homo sapiens
agctccagagtctgaactattc

SEQ ID NO: 10066040 - DNA, 22 bp, Homo sapiens
agctccagaagcctgcaaggta

SEQ ID NO: 10066041 - DNA, 22 bp, Homo sapiens
agctccagattaattgtaggag

SEQ ID NO: 10066042 - DNA, 22 bp, Homo sapiens
agctccagggaaagagtggatc

SEQ ID NO: 10066043 - DNA, 22 bp, Homo sapiens
agctccaggataagacaggtgc

SEQ ID NO: 10066044 - DNA, 22 bp, Homo sapiens
agctccagcctcttctggaggt

SEQ ID NO: 10066045 - DNA, 22 bp, Homo sapiens
agctaaggatgactagtacttc

SEQ ID NO: 10066046 - DNA, 22 bp, Homo sapiens
cagcaagaaaattcacatgctc

SEQ ID NO: 10066047 - DNA, 20 bp, Homo sapiens
cagatgggacgtggaggagt

SEQ ID NO: 10066048 - DNA, 22 bp, Homo sapiens
cagatggggcaaggccatctgt

SEQ ID NO: 10066049 - DNA, 22 bp, Homo sapiens
agagcagctgtgacatggacag

SEQ ID NO: 10066050 - DNA, 22 bp, Homo sapiens
agagcagcttttcggaaccact

SEQ ID NO: 10066051 - DNA, 22 bp, Homo sapiens
agagcagctggctgcatctaga

SEQ ID NO: 10066052 - DNA, 22 bp, Homo sapiens
agagcagctgcattcagcacct

SEQ ID NO: 10066053 - DNA, 22 bp, Homo sapiens
agagcagctggggcagagacca

SEQ ID NO: 10066054 - DNA, 22 bp, Homo sapiens
agagcagcgtttgtggaacact

SEQ ID NO: 10066055 - DNA, 18 bp, Homo sapiens
agagcagcggcatcacac

SEQ ID NO: 10066056 - DNA, 22 bp, Homo sapiens
agagcagctcgctacctctcta

SEQ ID NO: 10066057 - DNA, 22 bp, Homo sapiens
agagcagctgacagcctgccat

SEQ ID NO: 10066058 - DNA, 22 bp, Homo sapiens
agacacctgccacccagagctc

SEQ ID NO: 10066059 - DNA, 20 bp, Homo sapiens
agagagcacaggcaggaaag

SEQ ID NO: 10066060 - DNA, 22 bp, Homo sapiens
agagagcaggacttcactgagc

SEQ ID NO: 10066061 - DNA, 22 bp, Homo sapiens
agagagcagtctggaagaaaca

SEQ ID NO: 10066062 - DNA, 17 bp, Homo sapiens
agagagagcatgccacc

SEQ ID NO: 10066063 - DNA, 22 bp, Homo sapiens
agagagaggcagcagtgctcac

SEQ ID NO: 10066064 - DNA, 22 bp, Homo sapiens
aatgtacagctgctgctgaagg

SEQ ID NO: 10066065 - DNA, 22 bp, Homo sapiens
agatttgttgtgagcaggaata

SEQ ID NO: 10066066 - DNA, 22 bp, Homo sapiens
agcacttctcatgggatcaggt

SEQ ID NO: 10066067 - DNA, 21 bp, Homo sapiens
agcaggtgaacctccagtaca

SEQ ID NO: 10066068 - DNA, 22 bp, Homo sapiens
agcagggctttggctggctttc

SEQ ID NO: 10066069 - DNA, 22 bp, Homo sapiens
agcaggtgaattcctggatgtg

SEQ ID NO: 10066070 - DNA, 22 bp, Homo sapiens
agcagggctgtgctccttccga

SEQ ID NO: 10066071 - DNA, 22 bp, Homo sapiens
agcagggcttctgtgcctgtgc

SEQ ID NO: 10066072 - DNA, 22 bp, Homo sapiens
agcaggcatagagtagcactca

SEQ ID NO: 10066073 - DNA, 22 bp, Homo sapiens
agcagccatccttagagaaaga

SEQ ID NO: 10066074 - DNA, 21 bp, Homo sapiens
agcagccatttcacagagact

SEQ ID NO: 10066075 - DNA, 22 bp, Homo sapiens
agcaggagcccttatcaccagg

SEQ ID NO: 10066076 - DNA, 21 bp, Homo sapiens
agcaggaggcagtcacagctc

SEQ ID NO: 10066077 - DNA, 21 bp, Homo sapiens
agcaggaggcagtcacagctc

SEQ ID NO: 10066078 - DNA, 22 bp, Homo sapiens
agctcaggctctgcagggacta

SEQ ID NO: 10066079 - DNA, 22 bp, Homo sapiens
agctcaggtcattccagggatg

SEQ ID NO: 10066080 - DNA, 22 bp, Homo sapiens
agctcaggtctcaggaggtgtc

SEQ ID NO: 10066081 - DNA, 22 bp, Homo sapiens
agccctgggtcccagtcctggc

SEQ ID NO: 10066082 - DNA, 22 bp, Homo sapiens
agcatctgcatattgggagacc

SEQ ID NO: 10066083 - DNA, 22 bp, Homo sapiens
agcccaggtgactcatacaccc

SEQ ID NO: 10066084 - DNA, 22 bp, Homo sapiens
acagacagtaaatagtgtggct

SEQ ID NO: 10066085 - DNA, 17 bp, Homo sapiens
accacctctcaccagca

SEQ ID NO: 10066086 - DNA, 22 bp, Homo sapiens
accacctcatcaagctggattg

SEQ ID NO: 10066087 - DNA, 22 bp, Homo sapiens
accactgcactccagtctgggc

SEQ ID NO: 10066088 - DNA, 22 bp, Homo sapiens
accaggaaactgtgcccacgac

SEQ ID NO: 10066089 - DNA, 22 bp, Homo sapiens
accaggcagtcaccgtccagga

SEQ ID NO: 10066090 - DNA, 22 bp, Homo sapiens
aaggccaggccagatgacagtc

SEQ ID NO: 10066091 - DNA, 22 bp, Homo sapiens
acaggaggagcagctgtgtgcc

SEQ ID NO: 10066092 - DNA, 21 bp, Homo sapiens
acaggagaccgcctggcagtc

SEQ ID NO: 10066093 - DNA, 20 bp, Homo sapiens
acaggagatctgaggaaagg

SEQ ID NO: 10066094 - DNA, 19 bp, Homo sapiens
acaggcagaattgggtgtg

SEQ ID NO: 10066095 - DNA, 19 bp, Homo sapiens
acaggcagaattgggtgtg

SEQ ID NO: 10066096 - DNA, 22 bp, Homo sapiens
acaggcagagtcaggttgggtt

SEQ ID NO: 10066097 - DNA, 23 bp, Homo sapiens
acaggctcttaatcagtgctcct

SEQ ID NO: 10066098 - DNA, 22 bp, Homo sapiens
aagtggcagccttagaaggaga

SEQ ID NO: 10066099 - DNA, 22 bp, Homo sapiens
aagtggggcctggtggtacagt

SEQ ID NO: 10066100 - DNA, 22 bp, Homo sapiens
aagtgcaggtctcagctactct

SEQ ID NO: 10066101 - DNA, 22 bp, Homo sapiens
acctgggaaaaggagtggccat

SEQ ID NO: 10066102 - DNA, 22 bp, Homo sapiens
acctgggagagaggagccggcg

SEQ ID NO: 10066103 - DNA, 19 bp, Homo sapiens
accttgggcaagtgccttc

SEQ ID NO: 10066104 - DNA, 22 bp, Homo sapiens
aagtgaagaaatacatgagaat

SEQ ID NO: 10066105 - DNA, 22 bp, Homo sapiens
aagtgcagagagctgacgaact

SEQ ID NO: 10066106 - DNA, 22 bp, Homo sapiens
aagagccttggcaatgagtcct

SEQ ID NO: 10066107 - DNA, 22 bp, Homo sapiens
aagagcatggcaagaaaagggt

SEQ ID NO: 10066108 - DNA, 22 bp, Homo sapiens
aagagagagttcctaggcaaaa

SEQ ID NO: 10066109 - DNA, 22 bp, Homo sapiens
aacagcagctgaggagctgggc

SEQ ID NO: 10066110 - DNA, 22 bp, Homo sapiens
aaatggctacaagatgtgctct

SEQ ID NO: 10066111 - DNA, 22 bp, Homo sapiens
aaatggctgcatttgtgtaaat

SEQ ID NO: 10066112 - DNA, 22 bp, Homo sapiens
aaacatttttctaggtcttggt

SEQ ID NO: 10066113 - DNA, 22 bp, Homo sapiens
aaatatgatactcccttttagt

SEQ ID NO: 10066114 - DNA, 22 bp, Homo sapiens
aaaggcatgctgctgaatgatg

SEQ ID NO: 10066115 - DNA, 22 bp, Homo sapiens
aaaggcatggaacagattctcc

SEQ ID NO: 10066116 - DNA, 22 bp, Homo sapiens
acaccccaccagtaactgaggg

SEQ ID NO: 10066117 - DNA, 22 bp, Homo sapiens
acaccttctgagaactgagcag

SEQ ID NO: 10066118 - DNA, 22 bp, Homo sapiens
acagagcacatagattggagtt

SEQ ID NO: 10066119 - DNA, 22 bp, Homo sapiens
acactagatgccaatagcaccc

SEQ ID NO: 10066120 - DNA, 22 bp, Homo sapiens
aagcccagaatcaagtctactg

SEQ ID NO: 10066121 - DNA, 22 bp, Homo sapiens
aagcccagatgagatccctgga

SEQ ID NO: 10066122 - DNA, 22 bp, Homo sapiens
aagccagcattttcccattcct

SEQ ID NO: 10066123 - DNA, 22 bp, Homo sapiens
aaggacagggatggttgattgt

SEQ ID NO: 10066124 - DNA, 22 bp, Homo sapiens
aaggccagactctggaatgaca

SEQ ID NO: 10066125 - DNA, 22 bp, Homo sapiens
aaggcatttgttggatttctca

SEQ ID NO: 10066126 - DNA, 22 bp, Homo sapiens
aaggcattggactagtatcaga

SEQ ID NO: 10066127 - DNA, 23 bp, Homo sapiens
gtcagggctggggtcagagtgac

SEQ ID NO: 10066128 - DNA, 22 bp, Homo sapiens
gtcaggggatgtgctggtggcc

SEQ ID NO: 10066129 - DNA, 22 bp, Homo sapiens
gtcaggggccatgggccaagga

SEQ ID NO: 10066130 - DNA, 23 bp, Homo sapiens
gtcagggcagctcccagcccaac

SEQ ID NO: 10066131 - DNA, 19 bp, Homo sapiens
gtcctctcaacaacccggg

SEQ ID NO: 10066132 - DNA, 23 bp, Homo sapiens
gtctcccatagcgctcccaggct

SEQ ID NO: 10066133 - DNA, 22 bp, Homo sapiens
gtctcccatctctgtccttgtg

SEQ ID NO: 10066134 - DNA, 22 bp, Homo sapiens
gtctcctccctttcattcacct

SEQ ID NO: 10066135 - DNA, 22 bp, Homo sapiens
gtctcctcttcatatacctgtt

SEQ ID NO: 10066136 - DNA, 22 bp, Homo sapiens
gtagagcagggagcaggaagct

SEQ ID NO: 10066137 - DNA, 17 bp, Homo sapiens
gtaaggcttgcagatgc

SEQ ID NO: 10066138 - DNA, 22 bp, Homo sapiens
gtgcaaaaatctatcaccagca

SEQ ID NO: 10066139 - DNA, 22 bp, Homo sapiens
gtcttcttttcagtctgcttgt

SEQ ID NO: 10066140 - DNA, 22 bp, Homo sapiens
gtgaggcagggaaagaggataa

SEQ ID NO: 10066141 - DNA, 22 bp, Homo sapiens
gtctccttgtggatctcaagga

SEQ ID NO: 10066142 - DNA, 22 bp, Homo sapiens
ggggcacacttttggtagatat

SEQ ID NO: 10066143 - DNA, 22 bp, Homo sapiens
ggggcagctcccgagggcagga

SEQ ID NO: 10066144 - DNA, 22 bp, Homo sapiens
gggggagctacaggtcccttgg

SEQ ID NO: 10066145 - DNA, 22 bp, Homo sapiens
ggtagcacagggcactgatctc

SEQ ID NO: 10066146 - DNA, 23 bp, Homo sapiens
gggtccagagacaggcatgggtg

SEQ ID NO: 10066147 - DNA, 22 bp, Homo sapiens
gggtcaggctcagcagggcagc

SEQ ID NO: 10066148 - DNA, 22 bp, Homo sapiens
gggtcaggcctcaaggtgggct

SEQ ID NO: 10066149 - DNA, 22 bp, Homo sapiens
ggtacagggcttcctggacaag

SEQ ID NO: 10066150 - DNA, 22 bp, Homo sapiens
ggtaccatgagatgccactaat

SEQ ID NO: 10066151 - DNA, 21 bp, Homo sapiens
ggtcttgggaggtgccctggg

SEQ ID NO: 10066152 - DNA, 22 bp, Homo sapiens
ggtgcatgtgagaaagactggg

SEQ ID NO: 10066153 - DNA, 19 bp, Homo sapiens
ggcgggtggactggagccc

SEQ ID NO: 10066154 - DNA, 22 bp, Homo sapiens
ggcatctcggaacacgcctccg

SEQ ID NO: 10066155 - DNA, 22 bp, Homo sapiens
ggcaggagctcaggttggttcc

SEQ ID NO: 10066156 - DNA, 22 bp, Homo sapiens
ggcaggggtgaggccactctga

SEQ ID NO: 10066157 - DNA, 22 bp, Homo sapiens
ggcaggggtggccttcctttgg

SEQ ID NO: 10066158 - DNA, 18 bp, Homo sapiens
ggcaggggtgaaccacag

SEQ ID NO: 10066159 - DNA, 22 bp, Homo sapiens
ggcaggtgacctggcctcccag

SEQ ID NO: 10066160 - DNA, 22 bp, Homo sapiens
ggagttggaggctccagggaac

SEQ ID NO: 10066161 - DNA, 22 bp, Homo sapiens
ggatgggaacttggtagggcat

SEQ ID NO: 10066162 - DNA, 22 bp, Homo sapiens
ggatgctcagtgcctgtgtcca

SEQ ID NO: 10066163 - DNA, 22 bp, Homo sapiens
ggatgctgatatagagcattct

SEQ ID NO: 10066164 - DNA, 22 bp, Homo sapiens
ggatgctgactttggagcatgg

SEQ ID NO: 10066165 - DNA, 22 bp, Homo sapiens
ggcagcagggctgtctccctac

SEQ ID NO: 10066166 - DNA, 19 bp, Homo sapiens
ggcagaaggtgtaggggga

SEQ ID NO: 10066167 - DNA, 22 bp, Homo sapiens
ggcagaagacaggcaaatcatg

SEQ ID NO: 10066168 - DNA, 19 bp, Homo sapiens
gggagctgaggtctttggt

SEQ ID NO: 10066169 - DNA, 20 bp, Homo sapiens
gggagctggaattgtcttag

SEQ ID NO: 10066170 - DNA, 22 bp, Homo sapiens
gggagctgagggacctctgtgg

SEQ ID NO: 10066171 - DNA, 22 bp, Homo sapiens
gggagctgagctggaagagaat

SEQ ID NO: 10066172 - DNA, 22 bp, Homo sapiens
gggagctgaggagccccgtcgg

SEQ ID NO: 10066173 - DNA, 21 bp, Homo sapiens
gggagctgacagcagcacggc

SEQ ID NO: 10066174 - DNA, 22 bp, Homo sapiens
gggagctgacctgcaggttccc

SEQ ID NO: 10066175 - DNA, 22 bp, Homo sapiens
gggagctgagctctgagccacg

SEQ ID NO: 10066176 - DNA, 22 bp, Homo sapiens
gggcagtgttgctctcaaagtc

SEQ ID NO: 10066177 - DNA, 22 bp, Homo sapiens
gggcacaggagaaggatctggc

SEQ ID NO: 10066178 - DNA, 22 bp, Homo sapiens
gggagctggagctggaagactc

SEQ ID NO: 10066179 - DNA, 22 bp, Homo sapiens
gggagctggatcgcgcgcccgg

SEQ ID NO: 10066180 - DNA, 22 bp, Homo sapiens
gggagctggagttgtgttgcct

SEQ ID NO: 10066181 - DNA, 21 bp, Homo sapiens
ggctgggtcatgcagctggcc

SEQ ID NO: 10066182 - DNA, 22 bp, Homo sapiens
ggctgggtcccagctgggagga

SEQ ID NO: 10066183 - DNA, 19 bp, Homo sapiens
ggctggagaaaggaatcag

SEQ ID NO: 10066184 - DNA, 22 bp, Homo sapiens
ggctccccaggtccaggagctg

SEQ ID NO: 10066185 - DNA, 22 bp, Homo sapiens
ggctccctgcctgtcctcagtc

SEQ ID NO: 10066186 - DNA, 22 bp, Homo sapiens
ggctccctgcaacctccgcctc

SEQ ID NO: 10066187 - DNA, 22 bp, Homo sapiens
ggctccctgggtgctcctgctc

SEQ ID NO: 10066188 - DNA, 22 bp, Homo sapiens
ggctccctggaaatcccgaggc

SEQ ID NO: 10066189 - DNA, 22 bp, Homo sapiens
ggctcccaggagggcctggagg

SEQ ID NO: 10066190 - DNA, 22 bp, Homo sapiens
ggcggtggcgtgaaggtggctg

SEQ ID NO: 10066191 - DNA, 22 bp, Homo sapiens
ggctcctctctggccgctcccg

SEQ ID NO: 10066192 - DNA, 22 bp, Homo sapiens
gctgggactgagacagtgacct

SEQ ID NO: 10066193 - DNA, 22 bp, Homo sapiens
gctgggagacagacttggaacc

SEQ ID NO: 10066194 - DNA, 22 bp, Homo sapiens
gctgggaggaatttggggaata

SEQ ID NO: 10066195 - DNA, 22 bp, Homo sapiens
gctgggagtcgcgtctgtggcc

SEQ ID NO: 10066196 - DNA, 16 bp, Homo sapiens
gctgggagggagaggt

SEQ ID NO: 10066197 - DNA, 22 bp, Homo sapiens
gctgggaggatctctccctgtc

SEQ ID NO: 10066198 - DNA, 20 bp, Homo sapiens
gctgggggtgtgctgagtga

SEQ ID NO: 10066199 - DNA, 22 bp, Homo sapiens
gctggggtctgtgaggagggct

SEQ ID NO: 10066200 - DNA, 22 bp, Homo sapiens
gctgtctgttcgagcgtgtgtt

SEQ ID NO: 10066201 - DNA, 22 bp, Homo sapiens
ggacacagtggaagacagcttg

SEQ ID NO: 10066202 - DNA, 22 bp, Homo sapiens
ggaaaggcctgggtgtcctggg

SEQ ID NO: 10066203 - DNA, 22 bp, Homo sapiens
ggacagagagtgaatatgacat

SEQ ID NO: 10066204 - DNA, 22 bp, Homo sapiens
ggacagagcagacgagcagcgg

SEQ ID NO: 10066205 - DNA, 22 bp, Homo sapiens
gctcaagccatcttagtagccc

SEQ ID NO: 10066206 - DNA, 22 bp, Homo sapiens
gctcagctgcacctggagagcc

SEQ ID NO: 10066207 - DNA, 22 bp, Homo sapiens
gctcactaaataacaggaagaa

SEQ ID NO: 10066208 - DNA, 22 bp, Homo sapiens
gcctggggccagcttgggctga

SEQ ID NO: 10066209 - DNA, 22 bp, Homo sapiens
gcctggtgaaaggcagagagcg

SEQ ID NO: 10066210 - DNA, 22 bp, Homo sapiens
gctcagggaaagagctcctgtc

SEQ ID NO: 10066211 - DNA, 22 bp, Homo sapiens
gctgccagctgcggcccacgcg

SEQ ID NO: 10066212 - DNA, 22 bp, Homo sapiens
gctgccactctgagcttgcttc

SEQ ID NO: 10066213 - DNA, 18 bp, Homo sapiens
gcagtctctctggtcttc

SEQ ID NO: 10066214 - DNA, 20 bp, Homo sapiens
gcagtctgtcacagagcatg

SEQ ID NO: 10066215 - DNA, 22 bp, Homo sapiens
gcctcagagggcagggtggtga

SEQ ID NO: 10066216 - DNA, 22 bp, Homo sapiens
gcccagtggtaaaagcaggcct

SEQ ID NO: 10066217 - DNA, 22 bp, Homo sapiens
gcccatcttctagcagctgtta

SEQ ID NO: 10066218 - DNA, 22 bp, Homo sapiens
gcccagggcgatggtcggggcc

SEQ ID NO: 10066219 - DNA, 22 bp, Homo sapiens
gcccagggcagggcaagagtga

SEQ ID NO: 10066220 - DNA, 22 bp, Homo sapiens
gccaggtgtagtggccacacct

SEQ ID NO: 10066221 - DNA, 23 bp, Homo sapiens
gcccagagaggctcaccaggaat

SEQ ID NO: 10066222 - DNA, 22 bp, Homo sapiens
gaggggctggggttgactccaa

SEQ ID NO: 10066223 - DNA, 22 bp, Homo sapiens
gaggggctgtggagctctctgg

SEQ ID NO: 10066224 - DNA, 22 bp, Homo sapiens
gcactgcatctactggcaagta

SEQ ID NO: 10066225 - DNA, 22 bp, Homo sapiens
gcactgcctgtgagccctggtt

SEQ ID NO: 10066226 - DNA, 22 bp, Homo sapiens
gcactgccctcttcggggttcc

SEQ ID NO: 10066227 - DNA, 22 bp, Homo sapiens
gcactgccatcaatgcatgaca

SEQ ID NO: 10066228 - DNA, 22 bp, Homo sapiens
gcactgggaagaatgagcctgt

SEQ ID NO: 10066229 - DNA, 18 bp, Homo sapiens
gcactctgactgcagagc

SEQ ID NO: 10066230 - DNA, 22 bp, Homo sapiens
gcagaggacacaggagggcaag

SEQ ID NO: 10066231 - DNA, 18 bp, Homo sapiens
gcacttcacagggatagt

SEQ ID NO: 10066232 - DNA, 20 bp, Homo sapiens
gcaggctccgggcttgggag

SEQ ID NO: 10066233 - DNA, 22 bp, Homo sapiens
gcaggctcccttgcagagcagg

SEQ ID NO: 10066234 - DNA, 22 bp, Homo sapiens
gcaggctcgttggaagtcccct

SEQ ID NO: 10066235 - DNA, 22 bp, Homo sapiens
gcaggctccaggccggcccctt

SEQ ID NO: 10066236 - DNA, 22 bp, Homo sapiens
gcaggctccaaggcctgggaga

SEQ ID NO: 10066237 - DNA, 22 bp, Homo sapiens
gcaggctccaactggaggagtt

SEQ ID NO: 10066238 - DNA, 22 bp, Homo sapiens
gcaggctcagagcagattagca

SEQ ID NO: 10066239 - DNA, 22 bp, Homo sapiens
gcaggctcactctgtttggctc

SEQ ID NO: 10066240 - DNA, 22 bp, Homo sapiens
gcaggctcaaaagctggtagga

SEQ ID NO: 10066241 - DNA, 22 bp, Homo sapiens
gcaggctcttctttctgcccag

SEQ ID NO: 10066242 - DNA, 22 bp, Homo sapiens
gcaggaggttgagccaggactg

SEQ ID NO: 10066243 - DNA, 22 bp, Homo sapiens
gcagctggagccagccagacac

SEQ ID NO: 10066244 - DNA, 22 bp, Homo sapiens
gcagctgccccgactgtgagtc

SEQ ID NO: 10066245 - DNA, 22 bp, Homo sapiens
tcaggcagatgcagggatggat

SEQ ID NO: 10066246 - DNA, 22 bp, Homo sapiens
tcaggcagcattaaacttcagc

SEQ ID NO: 10066247 - DNA, 22 bp, Homo sapiens
tcaggcagctccaggaatggta

SEQ ID NO: 10066248 - DNA, 22 bp, Homo sapiens
tcaggaggtctgctgcggggtg

SEQ ID NO: 10066249 - DNA, 21 bp, Homo sapiens
tcaggcaggcgcagagggaag

SEQ ID NO: 10066250 - DNA, 22 bp, Homo sapiens
tcaggcaggttggctgcaggtc

SEQ ID NO: 10066251 - DNA, 22 bp, Homo sapiens
tcagaggcttctgctcacctca

SEQ ID NO: 10066252 - DNA, 22 bp, Homo sapiens
tcagggcacaggcctgtgggtt

SEQ ID NO: 10066253 - DNA, 22 bp, Homo sapiens
tcagggcacattctgcagtggc

SEQ ID NO: 10066254 - DNA, 22 bp, Homo sapiens
tcagggcaccaaaaaagatgcc

SEQ ID NO: 10066255 - DNA, 22 bp, Homo sapiens
tcagggcaatgtccctcagaag

SEQ ID NO: 10066256 - DNA, 22 bp, Homo sapiens
tcagggcaagtctcagaaggtt

SEQ ID NO: 10066257 - DNA, 22 bp, Homo sapiens
tcagggcaaagggcagagtttg

SEQ ID NO: 10066258 - DNA, 22 bp, Homo sapiens
tcagggcaagattggttaataa

SEQ ID NO: 10066259 - DNA, 22 bp, Homo sapiens
tcagggcaaaagggaaaccatt

SEQ ID NO: 10066260 - DNA, 22 bp, Homo sapiens
tcaggctcaaagggccggatga

SEQ ID NO: 10066261 - DNA, 22 bp, Homo sapiens
tcaggctcaggaatgtgtttat

SEQ ID NO: 10066262 - DNA, 20 bp, Homo sapiens
tcaggctccgcattaactta

SEQ ID NO: 10066263 - DNA, 22 bp, Homo sapiens
tcaggctctacacttgacacac

SEQ ID NO: 10066264 - DNA, 22 bp, Homo sapiens
tcaggctctcagaccaacagca

SEQ ID NO: 10066265 - DNA, 18 bp, Homo sapiens
tcaggctctctggctaga

SEQ ID NO: 10066266 - DNA, 22 bp, Homo sapiens
tcaggctccctgctgggctctg

SEQ ID NO: 10066267 - DNA, 22 bp, Homo sapiens
tcaggctcaggttaggggccaa

SEQ ID NO: 10066268 - DNA, 22 bp, Homo sapiens
tcaggctctgccacctagatta

SEQ ID NO: 10066269 - DNA, 22 bp, Homo sapiens
tcaggctctgagctgatgctaa

SEQ ID NO: 10066270 - DNA, 22 bp, Homo sapiens
tcaggctctgggtacacctgac

SEQ ID NO: 10066271 - DNA, 22 bp, Homo sapiens
tcagggcagcctaaggcacctc

SEQ ID NO: 10066272 - DNA, 21 bp, Homo sapiens
tcagggcagctgctcttcaga

SEQ ID NO: 10066273 - DNA, 22 bp, Homo sapiens
tcagggcactgtcacctgatat

SEQ ID NO: 10066274 - DNA, 22 bp, Homo sapiens
tcagggcacgtttctgcaatgc

SEQ ID NO: 10066275 - DNA, 16 bp, Homo sapiens
tcagggcagaatggca

SEQ ID NO: 10066276 - DNA, 22 bp, Homo sapiens
tcagggcagaatccaaagaatt

SEQ ID NO: 10066277 - DNA, 22 bp, Homo sapiens
tcactgcttcttggagaatgtc

SEQ ID NO: 10066278 - DNA, 22 bp, Homo sapiens
tcactgggagatgtgggaaggg

SEQ ID NO: 10066279 - DNA, 22 bp, Homo sapiens
tcactggggcctttggtcagga

SEQ ID NO: 10066280 - DNA, 22 bp, Homo sapiens
tcagaacatcccagatagtaga

SEQ ID NO: 10066281 - DNA, 23 bp, Homo sapiens
tcagaacagttcttggtgcatag

SEQ ID NO: 10066282 - DNA, 20 bp, Homo sapiens
tcagaacagtagaggagcta

SEQ ID NO: 10066283 - DNA, 22 bp, Homo sapiens
tcaccttgtgatctccctgcct

SEQ ID NO: 10066284 - DNA, 22 bp, Homo sapiens
tcaccttgtgatccgcccacct

SEQ ID NO: 10066285 - DNA, 22 bp, Homo sapiens
tcacctctactcagcctagttc

SEQ ID NO: 10066286 - DNA, 22 bp, Homo sapiens
tcacctctactcagcctagttc

SEQ ID NO: 10066287 - DNA, 22 bp, Homo sapiens
tcacctgggagggctgtggtag

SEQ ID NO: 10066288 - DNA, 23 bp, Homo sapiens
tcagagagctgttgagagctgcc

SEQ ID NO: 10066289 - DNA, 22 bp, Homo sapiens
tcagagaggattttaataagtg

SEQ ID NO: 10066290 - DNA, 22 bp, Homo sapiens
tcagagagcctcaggcactgcc

SEQ ID NO: 10066291 - DNA, 20 bp, Homo sapiens
tcagagagagggtgccactt

SEQ ID NO: 10066292 - DNA, 22 bp, Homo sapiens
tcagagagcagaacttttttac

SEQ ID NO: 10066293 - DNA, 18 bp, Homo sapiens
tcagagagcagctttatt

SEQ ID NO: 10066294 - DNA, 22 bp, Homo sapiens
tcagagagaaatagtttttgac

SEQ ID NO: 10066295 - DNA, 18 bp, Homo sapiens
tcagagagaatagtaatt

SEQ ID NO: 10066296 - DNA, 22 bp, Homo sapiens
tcagaggcagctgatgttctgt

SEQ ID NO: 10066297 - DNA, 22 bp, Homo sapiens
tcagaacattgacattcttatt

SEQ ID NO: 10066298 - DNA, 22 bp, Homo sapiens
tcagaacatttaaaaagtggtt

SEQ ID NO: 10066299 - DNA, 22 bp, Homo sapiens
tcagaacattacattttgagct

SEQ ID NO: 10066300 - DNA, 22 bp, Homo sapiens
tcagaacatgtttgagtaagac

SEQ ID NO: 10066301 - DNA, 22 bp, Homo sapiens
tcagaacatcctggtttaaaat

SEQ ID NO: 10066302 - DNA, 22 bp, Homo sapiens
tcagaagcaggagtgtgcacaa

SEQ ID NO: 10066303 - DNA, 22 bp, Homo sapiens
tcagagaatgtccttcttcatt

SEQ ID NO: 10066304 - DNA, 22 bp, Homo sapiens
tcagagaattcgattaaatgca

SEQ ID NO: 10066305 - DNA, 22 bp, Homo sapiens
tcacagagaggttaagcagttg

SEQ ID NO: 10066306 - DNA, 22 bp, Homo sapiens
tcacagagagaatattgtgttt

SEQ ID NO: 10066307 - DNA, 22 bp, Homo sapiens
tcacagacacattaaacatgtg

SEQ ID NO: 10066308 - DNA, 19 bp, Homo sapiens
tcacagagttcttacggga

SEQ ID NO: 10066309 - DNA, 20 bp, Homo sapiens
tcacagagtagccttgtctg

SEQ ID NO: 10066310 - DNA, 22 bp, Homo sapiens
tcacagagctcacagtttagca

SEQ ID NO: 10066311 - DNA, 23 bp, Homo sapiens
tcacagagcatactgcattttgc

SEQ ID NO: 10066312 - DNA, 22 bp, Homo sapiens
tcacagaatgtcagagttgggg

SEQ ID NO: 10066313 - DNA, 22 bp, Homo sapiens
tcacagcattcgcaatggacag

SEQ ID NO: 10066314 - DNA, 21 bp, Homo sapiens
tcaaacatgatctgggtcatc

SEQ ID NO: 10066315 - DNA, 22 bp, Homo sapiens
tcacacagctgacagagccttt

SEQ ID NO: 10066316 - DNA, 23 bp, Homo sapiens
tcacacagctggtcaggtacaga

SEQ ID NO: 10066317 - DNA, 22 bp, Homo sapiens
tcctccctaactcatgatgagt

SEQ ID NO: 10066318 - DNA, 22 bp, Homo sapiens
tcctccctaaatcctagactgt

SEQ ID NO: 10066319 - DNA, 23 bp, Homo sapiens
tcctccctgacttctacagcaca

SEQ ID NO: 10066320 - DNA, 21 bp, Homo sapiens
tcctccctgagctgtggggga

SEQ ID NO: 10066321 - DNA, 22 bp, Homo sapiens
tcctccctgagtggggacagct

SEQ ID NO: 10066322 - DNA, 22 bp, Homo sapiens
tcctccctgcactcagtgaagt

SEQ ID NO: 10066323 - DNA, 22 bp, Homo sapiens
tcctccctgggagcttctgagt

SEQ ID NO: 10066324 - DNA, 22 bp, Homo sapiens
tcctccctgtaccattcctctg

SEQ ID NO: 10066325 - DNA, 22 bp, Homo sapiens
tcctcccttctcactgggaagg

SEQ ID NO: 10066326 - DNA, 22 bp, Homo sapiens
tcctccagtcttggtgaggttg

SEQ ID NO: 10066327 - DNA, 22 bp, Homo sapiens
tcctccaggtctagggtggctt

SEQ ID NO: 10066328 - DNA, 22 bp, Homo sapiens
tcctccagtgtctggggccttg

SEQ ID NO: 10066329 - DNA, 23 bp, Homo sapiens
tcctcccaaatttcagcctcatt

SEQ ID NO: 10066330 - DNA, 21 bp, Homo sapiens
tcctcctccactaggctagcc

SEQ ID NO: 10066331 - DNA, 19 bp, Homo sapiens
tcctccctttggtgtcctg

SEQ ID NO: 10066332 - DNA, 22 bp, Homo sapiens
tcctcccttggggtttcgttat

SEQ ID NO: 10066333 - DNA, 22 bp, Homo sapiens
tcctcccttgactcctgctttt

SEQ ID NO: 10066334 - DNA, 22 bp, Homo sapiens
tcctccagaaactgaggcagaa

SEQ ID NO: 10066335 - DNA, 20 bp, Homo sapiens
tcctccagaagggcagggtg

SEQ ID NO: 10066336 - DNA, 22 bp, Homo sapiens
tccctgtagttcgtggtctttg

SEQ ID NO: 10066337 - DNA, 22 bp, Homo sapiens
tccctgtacactaacttgagac

SEQ ID NO: 10066338 - DNA, 22 bp, Homo sapiens
tccctgccaatgattggagcaa

SEQ ID NO: 10066339 - DNA, 22 bp, Homo sapiens
tcccaggcaaaggcagctcatt

SEQ ID NO: 10066340 - DNA, 22 bp, Homo sapiens
tcccaggattttaggctctcag

SEQ ID NO: 10066341 - DNA, 22 bp, Homo sapiens
tccaggacagcggcaggcagat

SEQ ID NO: 10066342 - DNA, 22 bp, Homo sapiens
tccacctccatgctgggcagag

SEQ ID NO: 10066343 - DNA, 22 bp, Homo sapiens
tccacagggatgttgagttctt

SEQ ID NO: 10066344 - DNA, 21 bp, Homo sapiens
tccaggcctcaggaagggatg

SEQ ID NO: 10066345 - DNA, 20 bp, Homo sapiens
tccagggcaaactcatcacc

SEQ ID NO: 10066346 - DNA, 20 bp, Homo sapiens
tccagggcaactagagtgtg

SEQ ID NO: 10066347 - DNA, 22 bp, Homo sapiens
tcccaggaaaacactcgaggac

SEQ ID NO: 10066348 - DNA, 22 bp, Homo sapiens
tcccaggaagatcccagggacc

SEQ ID NO: 10066349 - DNA, 22 bp, Homo sapiens
tcccagattcctgctcttatat

SEQ ID NO: 10066350 - DNA, 22 bp, Homo sapiens
tcccagagtttcctgtgtccca

SEQ ID NO: 10066351 - DNA, 22 bp, Homo sapiens
tcccacagtggtacagccctga

SEQ ID NO: 10066352 - DNA, 22 bp, Homo sapiens
tcccagagtcttctcctgtaat

SEQ ID NO: 10066353 - DNA, 22 bp, Homo sapiens
taagcacacaatatctggagag

SEQ ID NO: 10066354 - DNA, 22 bp, Homo sapiens
gtgcttttccttatttggtgct

SEQ ID NO: 10066355 - DNA, 22 bp, Homo sapiens
gtgcttttctgcagggtcctat

SEQ ID NO: 10066356 - DNA, 22 bp, Homo sapiens
gtgtgtttcaccctgacaccaa

SEQ ID NO: 10066357 - DNA, 22 bp, Homo sapiens
gttccaggaccctggcctctga

SEQ ID NO: 10066358 - DNA, 22 bp, Homo sapiens
tagccagctggataatgtgggg

SEQ ID NO: 10066359 - DNA, 23 bp, Homo sapiens
tagcacctctcacatagtgggtt

SEQ ID NO: 10066360 - DNA, 17 bp, Homo sapiens
tagcacagtgcctggta

SEQ ID NO: 10066361 - DNA, 22 bp, Homo sapiens
tagcacagcttcttgatgtcac

SEQ ID NO: 10066362 - DNA, 22 bp, Homo sapiens
tagcacagggcatatgcggtgg

SEQ ID NO: 10066363 - DNA, 18 bp, Homo sapiens
tagcacagagcaggatgt

SEQ ID NO: 10066364 - DNA, 22 bp, Homo sapiens
tagagcagccttcagagcagtt

SEQ ID NO: 10066365 - DNA, 23 bp, Homo sapiens
tagagcagggaaatctgtcagag

SEQ ID NO: 10066366 - DNA, 22 bp, Homo sapiens
tagagcagatagtgaaacagaa

SEQ ID NO: 10066367 - DNA, 22 bp, Homo sapiens
tagagcagtgttgtccatcaga

SEQ ID NO: 10066368 - DNA, 22 bp, Homo sapiens
taggctggaacttaggcagagg

SEQ ID NO: 10066369 - DNA, 22 bp, Homo sapiens
taggctggaggaagcagtgcct

SEQ ID NO: 10066370 - DNA, 22 bp, Homo sapiens
tagcccagatgattgaaccatg

SEQ ID NO: 10066371 - DNA, 22 bp, Homo sapiens
tagcccagatacaaatcatgat

SEQ ID NO: 10066372 - DNA, 22 bp, Homo sapiens
tagcccagagtcccaattccag

SEQ ID NO: 10066373 - DNA, 22 bp, Homo sapiens
tagcccagagagccaggggctt

SEQ ID NO: 10066374 - DNA, 19 bp, Homo sapiens
tagcccagagcctggctac

SEQ ID NO: 10066375 - DNA, 22 bp, Homo sapiens
tagcccagaagagggaagcaac

SEQ ID NO: 10066376 - DNA, 22 bp, Homo sapiens
tagcccagaaagcaaatgtctc

SEQ ID NO: 10066377 - DNA, 22 bp, Homo sapiens
tatcaaaggctatgtgattttt

SEQ ID NO: 10066378 - DNA, 23 bp, Homo sapiens
tatctgttctctgagtgtttggt

SEQ ID NO: 10066379 - DNA, 22 bp, Homo sapiens
ccttgggaggctcccagggaga

SEQ ID NO: 10066380 - DNA, 22 bp, Homo sapiens
ccttggggaactggacgtgctg

SEQ ID NO: 10066381 - DNA, 20 bp, Homo sapiens
ccttctccagcttgttcttg

SEQ ID NO: 10066382 - DNA, 22 bp, Homo sapiens
ccttctgctggtcatcccagtg

SEQ ID NO: 10066383 - DNA, 22 bp, Homo sapiens
ccttcttgaggtagcacattct

SEQ ID NO: 10066384 - DNA, 22 bp, Homo sapiens
cctttctgatggcctcccagcc

SEQ ID NO: 10066385 - DNA, 22 bp, Homo sapiens
cctttggggtcctgcctgggct

SEQ ID NO: 10066386 - DNA, 22 bp, Homo sapiens
cctttggggctttactgtggaa

SEQ ID NO: 10066387 - DNA, 22 bp, Homo sapiens
cctttggagcaactgagagcta

SEQ ID NO: 10066388 - DNA, 22 bp, Homo sapiens
tgttgcccaggttctctcctgc

SEQ ID NO: 10066389 - DNA, 22 bp, Homo sapiens
cggctggtgtcgggcacagcaa

SEQ ID NO: 10066390 - DNA, 23 bp, Homo sapiens
ttcagggcctcagaggtgaagct

SEQ ID NO: 10066391 - DNA, 22 bp, Homo sapiens
ttcctctcctcccaccaggtga

SEQ ID NO: 10066392 - DNA, 22 bp, Homo sapiens
cgtcctgggtctgggaaggcat

SEQ ID NO: 10066393 - DNA, 21 bp, Homo sapiens
ttctccttcttgatccaagca

SEQ ID NO: 10066394 - DNA, 22 bp, Homo sapiens
ttctccttgaaaagctgcatct

SEQ ID NO: 10066395 - DNA, 22 bp, Homo sapiens
ttctccttcctggttttcaggc

SEQ ID NO: 10066396 - DNA, 22 bp, Homo sapiens
ttctccttattcatagttgtct

SEQ ID NO: 10066397 - DNA, 22 bp, Homo sapiens
ttctccttggtttatgggacat

SEQ ID NO: 10066398 - DNA, 22 bp, Homo sapiens
ttctccttgttcccttcaattg

SEQ ID NO: 10066399 - DNA, 22 bp, Homo sapiens
ttctcctttcattccctgtaga

SEQ ID NO: 10066400 - DNA, 22 bp, Homo sapiens
ttctcctttgtaattctcatcc

SEQ ID NO: 10066401 - DNA, 22 bp, Homo sapiens
ctagggctcgcaagggctggag

SEQ ID NO: 10066402 - DNA, 22 bp, Homo sapiens
ctcaggccattcctaccaaggg

SEQ ID NO: 10066403 - DNA, 22 bp, Homo sapiens
ctcagaaagcaatctggtgagg

SEQ ID NO: 10066404 - DNA, 19 bp, Homo sapiens
ttgctggagaaaaaggaga

SEQ ID NO: 10066405 - DNA, 20 bp, Homo sapiens
ctctcacagctccctcagcc

SEQ ID NO: 10066406 - DNA, 22 bp, Homo sapiens
ctcccaggggaactatcaagta

SEQ ID NO: 10066407 - DNA, 22 bp, Homo sapiens
ctccccacgcctggactaagag

SEQ ID NO: 10066408 - DNA, 19 bp, Homo sapiens
ctcctcagtcccagaggtc

SEQ ID NO: 10066409 - DNA, 22 bp, Homo sapiens
ctcctcagtcaggtctagggtc

SEQ ID NO: 10066410 - DNA, 22 bp, Homo sapiens
ctcctcagggctggttacatgg

SEQ ID NO: 10066411 - DNA, 21 bp, Homo sapiens
ctcctcaggaccagccacagg

SEQ ID NO: 10066412 - DNA, 22 bp, Homo sapiens
ctccctgtgtcttcacttggcc

SEQ ID NO: 10066413 - DNA, 22 bp, Homo sapiens
ctccctggtgtcccctccagga

SEQ ID NO: 10066414 - DNA, 22 bp, Homo sapiens
ctccctggcacagcgagaggtt

SEQ ID NO: 10066415 - DNA, 22 bp, Homo sapiens
ctccctggcagccgcactcctg

SEQ ID NO: 10066416 - DNA, 22 bp, Homo sapiens
ctccctggaggtgagctggcac

SEQ ID NO: 10066417 - DNA, 22 bp, Homo sapiens
ctcctcagttgtcccatggaga

SEQ ID NO: 10066418 - DNA, 22 bp, Homo sapiens
ctcctgcctgtgggactgagga

SEQ ID NO: 10066419 - DNA, 22 bp, Homo sapiens
ctgctgcctcgacattgggaca

SEQ ID NO: 10066420 - DNA, 22 bp, Homo sapiens
ctgctgcctagtccaagacgtg

SEQ ID NO: 10066421 - DNA, 22 bp, Homo sapiens
ctgctgccttccaaaggccagg

SEQ ID NO: 10066422 - DNA, 19 bp, Homo sapiens
ctgctctccttgacttgga

SEQ ID NO: 10066423 - DNA, 22 bp, Homo sapiens
ctgcctgcgccaccaccacgtc

SEQ ID NO: 10066424 - DNA, 22 bp, Homo sapiens
ctgcctgcatgctgccatagct

SEQ ID NO: 10066425 - DNA, 22 bp, Homo sapiens
ctgctcctgtccagcagggcca

SEQ ID NO: 10066426 - DNA, 22 bp, Homo sapiens
ctgctccccagcctgcgccttt

SEQ ID NO: 10066427 - DNA, 19 bp, Homo sapiens
ctgctccctccttctggca

SEQ ID NO: 10066428 - DNA, 22 bp, Homo sapiens
ctgccctgggccaggaagcggc

SEQ ID NO: 10066429 - DNA, 22 bp, Homo sapiens
ctgcctctattcactgaggcag

SEQ ID NO: 10066430 - DNA, 22 bp, Homo sapiens
ctgccctgggagtacctgtcct

SEQ ID NO: 10066431 - DNA, 22 bp, Homo sapiens
ctgccctgcttgatgacagcga

SEQ ID NO: 10066432 - DNA, 22 bp, Homo sapiens
ctgccctgagggcctgtgtgtt

SEQ ID NO: 10066433 - DNA, 22 bp, Homo sapiens
ctgccctgagtcatgccagatg

SEQ ID NO: 10066434 - DNA, 22 bp, Homo sapiens
ctgccctgcagctccacggact

SEQ ID NO: 10066435 - DNA, 22 bp, Homo sapiens
ctgcaggggcctcgagcacagg

SEQ ID NO: 10066436 - DNA, 22 bp, Homo sapiens
ctgagggagagaatggggcaaa

SEQ ID NO: 10066437 - DNA, 22 bp, Homo sapiens
ctgagggagacagtgcggacta

SEQ ID NO: 10066438 - DNA, 22 bp, Homo sapiens
gaaagagaggggctgagatgca

SEQ ID NO: 10066439 - DNA, 22 bp, Homo sapiens
cttcctgttgtatttgtgagcc

SEQ ID NO: 10066440 - DNA, 20 bp, Homo sapiens
cttccacacaagaagcacag

SEQ ID NO: 10066441 - DNA, 22 bp, Homo sapiens
ctggggaacgcagcgagcagcg

SEQ ID NO: 10066442 - DNA, 22 bp, Homo sapiens
ctggtgcacgtggctgcagtcg

SEQ ID NO: 10066443 - DNA, 22 bp, Homo sapiens
ctggtgcacattcgctctcata

SEQ ID NO: 10066444 - DNA, 22 bp, Homo sapiens
ctgtcctgtggtgacaggtaca

SEQ ID NO: 10066445 - DNA, 22 bp, Homo sapiens
ctgtcagtagaccccaagctag

SEQ ID NO: 10066446 - DNA, 22 bp, Homo sapiens
ctgggacacccagagctgcaga

SEQ ID NO: 10066447 - DNA, 23 bp, Homo sapiens
ctgggacatggtaggggcacaac

SEQ ID NO: 10066448 - DNA, 22 bp, Homo sapiens
ctgggagatctcctgagggcag

SEQ ID NO: 10066449 - DNA, 22 bp, Homo sapiens
ctgggagaggctgctccgctct

SEQ ID NO: 10066450 - DNA, 22 bp, Homo sapiens
ctgggacttgcagagcaggagg

SEQ ID NO: 10066451 - DNA, 22 bp, Homo sapiens
gaaggcaccctccatcactcac

SEQ ID NO: 10066452 - DNA, 22 bp, Homo sapiens
gaagccacagggaaggagaaca

SEQ ID NO: 10066453 - DNA, 22 bp, Homo sapiens
gaaggcataaaaccaattttgt

SEQ ID NO: 10066454 - DNA, 18 bp, Homo sapiens
gaaggcattcagtggctt

SEQ ID NO: 10066455 - DNA, 22 bp, Homo sapiens
gagaaaggcatccttggcttca

SEQ ID NO: 10066456 - DNA, 22 bp, Homo sapiens
gactcccctgggccccatccag

SEQ ID NO: 10066457 - DNA, 22 bp, Homo sapiens
gactcctcagtcaccctcagct

SEQ ID NO: 10066458 - DNA, 22 bp, Homo sapiens
gacagcagataagacctcatca

SEQ ID NO: 10066459 - DNA, 22 bp, Homo sapiens
gacagcagatgaagcctgcaga

SEQ ID NO: 10066460 - DNA, 22 bp, Homo sapiens
gacagagccagttggaggtagg

SEQ ID NO: 10066461 - DNA, 22 bp, Homo sapiens
gacagagctcccagagatttgc

SEQ ID NO: 10066462 - DNA, 22 bp, Homo sapiens
gacagagctgctctagattctg

SEQ ID NO: 10066463 - DNA, 22 bp, Homo sapiens
gacagagcagcacccagcccct

SEQ ID NO: 10066464 - DNA, 22 bp, Homo sapiens
gacagaggagaagatgctgtgg

SEQ ID NO: 10066465 - DNA, 22 bp, Homo sapiens
gaggagcacatgaggctgaggg

SEQ ID NO: 10066466 - DNA, 22 bp, Homo sapiens
gaggctccagcgacacctaggc

SEQ ID NO: 10066467 - DNA, 22 bp, Homo sapiens
gaggggctgggcagtccctgga

SEQ ID NO: 10066468 - DNA, 22 bp, Homo sapiens
gaggggctggctgtggtcccat

SEQ ID NO: 10066469 - DNA, 22 bp, Homo sapiens
gagcccagctgcggccctcagc

SEQ ID NO: 10066470 - DNA, 22 bp, Homo sapiens
gagcccagctctacctcagact

SEQ ID NO: 10066471 - DNA, 22 bp, Homo sapiens
gagcccagctaaatttatataa

SEQ ID NO: 10066472 - DNA, 22 bp, Homo sapiens
gagcccagattggaatttccca

SEQ ID NO: 10066473 - DNA, 22 bp, Homo sapiens
gagcccagcccagagccatatg

SEQ ID NO: 10066474 - DNA, 22 bp, Homo sapiens
gagcccaggatggtgtatggct

SEQ ID NO: 10066475 - DNA, 22 bp, Homo sapiens
gagcccaggagtttgatgctgc

SEQ ID NO: 10066476 - DNA, 22 bp, Homo sapiens
gagcccagctgtccttggcaaa

SEQ ID NO: 10066477 - DNA, 22 bp, Homo sapiens
gagcccaggaagtggaggctga

SEQ ID NO: 10066478 - DNA, 22 bp, Homo sapiens
gagcccagcttgcacatggagc

SEQ ID NO: 10066479 - DNA, 22 bp, Homo sapiens
gagcccagggcaggcaaggcag

SEQ ID NO: 10066480 - DNA, 22 bp, Homo sapiens
gagcccagggtgaaatagcagc

SEQ ID NO: 10066481 - DNA, 21 bp, Homo sapiens
gagcccaggcatctcattaat

SEQ ID NO: 10066482 - DNA, 22 bp, Homo sapiens
gagcccaggctggggttcagag

SEQ ID NO: 10066483 - DNA, 22 bp, Homo sapiens
gagcccaggcagaggttgcagt

SEQ ID NO: 10066484 - DNA, 22 bp, Homo sapiens
gagcccagtaggcaaagctgca

SEQ ID NO: 10066485 - DNA, 22 bp, Homo sapiens
gagcccaggttctgcttccagc

SEQ ID NO: 10066486 - DNA, 22 bp, Homo sapiens
gagcccagtctgctcctgcgcc

SEQ ID NO: 10066487 - DNA, 22 bp, Homo sapiens
gagcagtgactggagcatgaga

SEQ ID NO: 10066488 - DNA, 22 bp, Homo sapiens
gagctgagcctgggtggaccgc

SEQ ID NO: 10066489 - DNA, 22 bp, Homo sapiens
gagctgaggctcaggctggcgt

SEQ ID NO: 10066490 - DNA, 22 bp, Homo sapiens
gagctgaggctgaggcctcact

SEQ ID NO: 10066491 - DNA, 22 bp, Homo sapiens
gagctgaggtgatgtggtcgtt

SEQ ID NO: 10066492 - DNA, 22 bp, Homo sapiens
gagctgagggtctaggagggtt

SEQ ID NO: 10066493 - DNA, 22 bp, Homo sapiens
gagctgagtctgcagtcgccat

SEQ ID NO: 10066494 - DNA, 23 bp, Homo sapiens
tatgatggtatcaggagatgggg

SEQ ID NO: 10066495 - DNA, 22 bp, Homo sapiens
tatgatgggaggaatggaattt

SEQ ID NO: 10066496 - DNA, 22 bp, Homo sapiens
tatgatggcagcgattgctgag

SEQ ID NO: 10066497 - DNA, 22 bp, Homo sapiens
caggtgggcttgggagaacact

SEQ ID NO: 10066498 - DNA, 22 bp, Homo sapiens
caggtggggagagtgtggagca

SEQ ID NO: 10066499 - DNA, 22 bp, Homo sapiens
caggtggggcagctgtgggagc

SEQ ID NO: 10066500 - DNA, 19 bp, Homo sapiens
tcaaagcaagcatgttctg

SEQ ID NO: 10066501 - DNA, 22 bp, Homo sapiens
cagtggaggctcaagtgtgctt

SEQ ID NO: 10066502 - DNA, 22 bp, Homo sapiens
cagtgcagtttcccagatgctg

SEQ ID NO: 10066503 - DNA, 22 bp, Homo sapiens
cagtgcagaggtgcaagcatgt

SEQ ID NO: 10066504 - DNA, 22 bp, Homo sapiens
tcactcctcattgctgcccatt

SEQ ID NO: 10066505 - DNA, 22 bp, Homo sapiens
caggctcccaccctcctgcagc

SEQ ID NO: 10066506 - DNA, 22 bp, Homo sapiens
caggctccagcttcctgctcag

SEQ ID NO: 10066507 - DNA, 20 bp, Homo sapiens
caggctccgcaggactaggg

SEQ ID NO: 10066508 - DNA, 21 bp, Homo sapiens
caggctctgctagaggagcct

SEQ ID NO: 10066509 - DNA, 22 bp, Homo sapiens
caggctccttcccagggatggt

SEQ ID NO: 10066510 - DNA, 22 bp, Homo sapiens
caggcctggagtgcaatggcac

SEQ ID NO: 10066511 - DNA, 22 bp, Homo sapiens
cagggccaagctgcagcatctg

SEQ ID NO: 10066512 - DNA, 22 bp, Homo sapiens
cagggcattacttcaggtcctt

SEQ ID NO: 10066513 - DNA, 22 bp, Homo sapiens
cagggcatccgtgctccatgct

SEQ ID NO: 10066514 - DNA, 22 bp, Homo sapiens
cagggcatctggagtcgggcgg

SEQ ID NO: 10066515 - DNA, 22 bp, Homo sapiens
cagggcagttttacttctctct

SEQ ID NO: 10066516 - DNA, 22 bp, Homo sapiens
tagcagagtgattggccatgag

SEQ ID NO: 10066517 - DNA, 22 bp, Homo sapiens
cagggagctttcccaggaccct

SEQ ID NO: 10066518 - DNA, 22 bp, Homo sapiens
ccacagggctctaggcgcttcc

SEQ ID NO: 10066519 - DNA, 21 bp, Homo sapiens
ccacaggggctcccctgtcag

SEQ ID NO: 10066520 - DNA, 22 bp, Homo sapiens
ccagagcctgctgagccccatt

SEQ ID NO: 10066521 - DNA, 22 bp, Homo sapiens
ccagagcctcgcccggagcctc

SEQ ID NO: 10066522 - DNA, 22 bp, Homo sapiens
ccagagcctcgcccggagcctc

SEQ ID NO: 10066523 - DNA, 22 bp, Homo sapiens
ccagagcctcaacacaggtcct

SEQ ID NO: 10066524 - DNA, 22 bp, Homo sapiens
ccagagccggctccctcagctt

SEQ ID NO: 10066525 - DNA, 22 bp, Homo sapiens
ccagagcccgggacctggactt

SEQ ID NO: 10066526 - DNA, 22 bp, Homo sapiens
ccagagcccagcacacggtgct

SEQ ID NO: 10066527 - DNA, 22 bp, Homo sapiens
ccagagccagagaggtgcctgc

SEQ ID NO: 10066528 - DNA, 22 bp, Homo sapiens
ccagcaagtgcagatggccaag

SEQ ID NO: 10066529 - DNA, 22 bp, Homo sapiens
ccagatgtccctctcaggtttg

SEQ ID NO: 10066530 - DNA, 22 bp, Homo sapiens
tctcagagacctgaactccctg

SEQ ID NO: 10066531 - DNA, 22 bp, Homo sapiens
tctcaggcatctgtgtggcaca

SEQ ID NO: 10066532 - DNA, 22 bp, Homo sapiens
tcatcagagctcccccaaacgt

SEQ ID NO: 10066533 - DNA, 22 bp, Homo sapiens
tcatcagaggcatctggcaagg

SEQ ID NO: 10066534 - DNA, 20 bp, Homo sapiens
tcatcagataggttagtaca

SEQ ID NO: 10066535 - DNA, 22 bp, Homo sapiens
tcatcagaatcagggctttgaa

SEQ ID NO: 10066536 - DNA, 22 bp, Homo sapiens
tcatcagactgactgtggttct

SEQ ID NO: 10066537 - DNA, 22 bp, Homo sapiens
tcatcagagccattgttaagaa

SEQ ID NO: 10066538 - DNA, 22 bp, Homo sapiens
tcatcagagaacattttgcctt

SEQ ID NO: 10066539 - DNA, 22 bp, Homo sapiens
catctacaggagaatgtcactg

SEQ ID NO: 10066540 - DNA, 18 bp, Homo sapiens
catctacaaatgccagaa

SEQ ID NO: 10066541 - DNA, 22 bp, Homo sapiens
catccctgtctgccactctgaa

SEQ ID NO: 10066542 - DNA, 22 bp, Homo sapiens
tcaggaggcgtgctggggtaca

SEQ ID NO: 10066543 - DNA, 22 bp, Homo sapiens
catcaaagcttttttctgtgtt

SEQ ID NO: 10066544 - DNA, 22 bp, Homo sapiens
tcaggcagagggagaagccaag

SEQ ID NO: 10066545 - DNA, 23 bp, Homo sapiens
catgtacacacagctgtacagtg

SEQ ID NO: 10066546 - DNA, 22 bp, Homo sapiens
tccaggctttggggcaggagcg

SEQ ID NO: 10066547 - DNA, 22 bp, Homo sapiens
tccagggcatggggagagagtg

SEQ ID NO: 10066548 - DNA, 22 bp, Homo sapiens
tccagggcatgctcagactcag

SEQ ID NO: 10066549 - DNA, 22 bp, Homo sapiens
tccagggttgtgggcttcagca

SEQ ID NO: 10066550 - DNA, 23 bp, Homo sapiens
tccagggcagtggctgggtctgc

SEQ ID NO: 10066551 - DNA, 22 bp, Homo sapiens
tccagggcagtgactacagcgg

SEQ ID NO: 10066552 - DNA, 22 bp, Homo sapiens
catgctgcaggagctcttctca

SEQ ID NO: 10066553 - DNA, 22 bp, Homo sapiens
ccctccctttgcagcagtgcat

SEQ ID NO: 10066554 - DNA, 22 bp, Homo sapiens
ccctcccttccaagttgaggac

SEQ ID NO: 10066555 - DNA, 22 bp, Homo sapiens
ccctccctgtgtgcctcatttg

SEQ ID NO: 10066556 - DNA, 22 bp, Homo sapiens
ccctccctgaagaagttactct

SEQ ID NO: 10066557 - DNA, 22 bp, Homo sapiens
ccctccctttgtctttatgaac

SEQ ID NO: 10066558 - DNA, 22 bp, Homo sapiens
ccctcctcaactctggcttcca

SEQ ID NO: 10066559 - DNA, 19 bp, Homo sapiens
tggaggaagtatatttcat

SEQ ID NO: 10066560 - DNA, 22 bp, Homo sapiens
tggaggaagtggctggccagaa

SEQ ID NO: 10066561 - DNA, 21 bp, Homo sapiens
tggaggaataaagcacagaag

SEQ ID NO: 10066562 - DNA, 18 bp, Homo sapiens
tggaggaatcacaatggc

SEQ ID NO: 10066563 - DNA, 22 bp, Homo sapiens
tggaggccaaggcaggcggatc

SEQ ID NO: 10066564 - DNA, 22 bp, Homo sapiens
cccttgggcttcagccctaccg

SEQ ID NO: 10066565 - DNA, 22 bp, Homo sapiens
cccttgggcttccacccagccc

SEQ ID NO: 10066566 - DNA, 22 bp, Homo sapiens
tgctgcctttactgggatttaa

SEQ ID NO: 10066567 - DNA, 22 bp, Homo sapiens
ccccaggacacatggaccaagt

SEQ ID NO: 10066568 - DNA, 22 bp, Homo sapiens
ccccaggacgtggccctcatag

SEQ ID NO: 10066569 - DNA, 22 bp, Homo sapiens
ccccaggagaaatcttaaacta

SEQ ID NO: 10066570 - DNA, 22 bp, Homo sapiens
ccctccctctgctgggtgtaga

SEQ ID NO: 10066571 - DNA, 22 bp, Homo sapiens
ccctccctatgtagatgatgtt

SEQ ID NO: 10066572 - DNA, 22 bp, Homo sapiens
ccctccccacaaagcttcacac

SEQ ID NO: 10066573 - DNA, 22 bp, Homo sapiens
tgcttgctggaggcagacagaa

SEQ ID NO: 10066574 - DNA, 22 bp, Homo sapiens
tgcttgcttcagccctcatctt

SEQ ID NO: 10066575 - DNA, 22 bp, Homo sapiens
tgcttgcttctcacatgcacct

SEQ ID NO: 10066576 - DNA, 22 bp, Homo sapiens
tgcttgctgggccaatggcaat

SEQ ID NO: 10066577 - DNA, 22 bp, Homo sapiens
cctgcctcccagaggtcctcta

SEQ ID NO: 10066578 - DNA, 22 bp, Homo sapiens
cctgcctcatcaacttgtcgtg

SEQ ID NO: 10066579 - DNA, 22 bp, Homo sapiens
cctgcctcaggactctgcatat

SEQ ID NO: 10066580 - DNA, 22 bp, Homo sapiens
cctgcagggtgctgccacagat

SEQ ID NO: 10066581 - DNA, 22 bp, Homo sapiens
tggggagcacggtagggaaatg

SEQ ID NO: 10066582 - DNA, 22 bp, Homo sapiens
tgggctcagtgggagaaagggc

SEQ ID NO: 10066583 - DNA, 21 bp, Homo sapiens
tgggcctcaagtgggtggcag

SEQ ID NO: 10066584 - DNA, 22 bp, Homo sapiens
tgggagagaataatcaataggt

SEQ ID NO: 10066585 - DNA, 22 bp, Homo sapiens
tgggacaggaggcctctggaga

SEQ ID NO: 10066586 - DNA, 22 bp, Homo sapiens
tgggacaggaggcctctggaga

SEQ ID NO: 10066587 - DNA, 22 bp, Homo sapiens
tgggacagagtgagctttggcc

SEQ ID NO: 10066588 - DNA, 19 bp, Homo sapiens
cctctcccatgcttacctc

SEQ ID NO: 10066589 - DNA, 22 bp, Homo sapiens
cctctcccagggagagcctgag

SEQ ID NO: 10066590 - DNA, 22 bp, Homo sapiens
tggcttggtcctggcccttccc

SEQ ID NO: 10066591 - DNA, 22 bp, Homo sapiens
cctccagggcagacggggagca

SEQ ID NO: 10066592 - DNA, 22 bp, Homo sapiens
tggccaatggctccggcctcat

SEQ ID NO: 10066593 - DNA, 22 bp, Homo sapiens
tggcagtgggaagctggaagtc

SEQ ID NO: 10066594 - DNA, 22 bp, Homo sapiens
tggcagtggctttgctggtgga

SEQ ID NO: 10066595 - DNA, 22 bp, Homo sapiens
tggcagtggctcagagtgcaga

SEQ ID NO: 10066596 - DNA, 22 bp, Homo sapiens
tggcagtgtcttatcaggagtg

SEQ ID NO: 10066597 - DNA, 22 bp, Homo sapiens
tggcagtgtcttgctggggcag

SEQ ID NO: 10066598 - DNA, 22 bp, Homo sapiens
cctcctctgtgcagctgtgggt

SEQ ID NO: 10066599 - DNA, 22 bp, Homo sapiens
cctcctggcctgtgcagagccc

SEQ ID NO: 10066600 - DNA, 22 bp, Homo sapiens
ccaggcagccaagtgtgtgtgt

SEQ ID NO: 10066601 - DNA, 21 bp, Homo sapiens
ccaggcagagctgtgagttct

SEQ ID NO: 10066602 - DNA, 22 bp, Homo sapiens
ccaggaggcttcgtccgtggag

SEQ ID NO: 10066603 - DNA, 22 bp, Homo sapiens
ccaggcacactgccctgccctt

SEQ ID NO: 10066604 - DNA, 22 bp, Homo sapiens
ccaggaggctcttgtccctggt

SEQ ID NO: 10066605 - DNA, 22 bp, Homo sapiens
ccaggaggctctgactggaccc

SEQ ID NO: 10066606 - DNA, 22 bp, Homo sapiens
tctgttccatgcagtgtcagat

SEQ ID NO: 10066607 - DNA, 21 bp, Homo sapiens
ccaggctgggagggcagttcc

SEQ ID NO: 10066608 - DNA, 22 bp, Homo sapiens
ccagggcaacgctgtctcagag

SEQ ID NO: 10066609 - DNA, 22 bp, Homo sapiens
ccagggcaaatgagatcatagc

SEQ ID NO: 10066610 - DNA, 22 bp, Homo sapiens
ccagggcaattatttggagggt

SEQ ID NO: 10066611 - DNA, 22 bp, Homo sapiens
ccagggcaataggaacactttt

SEQ ID NO: 10066612 - DNA, 22 bp, Homo sapiens
ccagggcacgttgggacagtac

SEQ ID NO: 10066613 - DNA, 22 bp, Homo sapiens
ccagggcagggaccacgtgtct

SEQ ID NO: 10066614 - DNA, 22 bp, Homo sapiens
ccagggcaggggctggagttca

SEQ ID NO: 10066615 - DNA, 22 bp, Homo sapiens
ccagggctctgcttctgccatg

SEQ ID NO: 10066616 - DNA, 22 bp, Homo sapiens
ccagggcagtgggagaaggtgc

SEQ ID NO: 10066617 - DNA, 22 bp, Homo sapiens
ccagggcatcacatccagtgtt

SEQ ID NO: 10066618 - DNA, 22 bp, Homo sapiens
ccagggcatcctcacatcgcag

SEQ ID NO: 10066619 - DNA, 22 bp, Homo sapiens
ccagggcatgggaagaactgaa

SEQ ID NO: 10066620 - DNA, 22 bp, Homo sapiens
ccagtgcctatctcctctggga

SEQ ID NO: 10066621 - DNA, 22 bp, Homo sapiens
ccagggctgctgtgggactcca

SEQ ID NO: 10066622 - DNA, 21 bp, Homo sapiens
tgagcaggtgctgcttttatg

SEQ ID NO: 10066623 - DNA, 22 bp, Homo sapiens
tgagcaggtcaagactccagct

SEQ ID NO: 10066624 - DNA, 22 bp, Homo sapiens
ccatccagaccagtccatgggt

SEQ ID NO: 10066625 - DNA, 22 bp, Homo sapiens
ccatcagagggctgctctgcaa

SEQ ID NO: 10066626 - DNA, 22 bp, Homo sapiens
ccatcagacaattctttctctt

SEQ ID NO: 10066627 - DNA, 22 bp, Homo sapiens
ccatcagattagcaaaatccag

SEQ ID NO: 10066628 - DNA, 22 bp, Homo sapiens
cccaagggatgcttgagtagtt

SEQ ID NO: 10066629 - DNA, 22 bp, Homo sapiens
cccaaggggtgttgatggagga

SEQ ID NO: 10066630 - DNA, 22 bp, Homo sapiens
cccaagggtgcccagcagagga

SEQ ID NO: 10066631 - DNA, 22 bp, Homo sapiens
tgcacagatctggtggcaagga

SEQ ID NO: 10066632 - DNA, 22 bp, Homo sapiens
cccaaggaataggatcccagga

SEQ ID NO: 10066633 - DNA, 16 bp, Homo sapiens
cccaaggagctccagg

SEQ ID NO: 10066634 - DNA, 22 bp, Homo sapiens
tgcagggccttgttgatgtgct

SEQ ID NO: 10066635 - DNA, 22 bp, Homo sapiens
cccagcaggcatgttgggagga

SEQ ID NO: 10066636 - DNA, 22 bp, Homo sapiens
tgcagccaattcattcattctt

SEQ ID NO: 10066637 - DNA, 22 bp, Homo sapiens
tgcagctgcaagtccaggtcag

SEQ ID NO: 10066638 - DNA, 19 bp, Homo sapiens
ttcccctccccagggatag

SEQ ID NO: 10066639 - DNA, 22 bp, Homo sapiens
ttcccctctcagatctggccta

SEQ ID NO: 10066640 - DNA, 19 bp, Homo sapiens
ttcccaggaaaggggtgca

SEQ ID NO: 10066641 - DNA, 22 bp, Homo sapiens
ttcccaggactctgggtgtctt

SEQ ID NO: 10066642 - DNA, 22 bp, Homo sapiens
ttcccaggaagcctctccaagc

SEQ ID NO: 10066643 - DNA, 19 bp, Homo sapiens
ttcccaggaaaggggtgca

SEQ ID NO: 10066644 - DNA, 22 bp, Homo sapiens
ttcccaggtaattctgaggcag

SEQ ID NO: 10066645 - DNA, 22 bp, Homo sapiens
ttcccaggactctgggtgtctt

SEQ ID NO: 10066646 - DNA, 22 bp, Homo sapiens
ttcccaggctgtgctaccagag

SEQ ID NO: 10066647 - DNA, 22 bp, Homo sapiens
ttccatgagctctgagttcaca

SEQ ID NO: 10066648 - DNA, 22 bp, Homo sapiens
ttcagaaatgaatattggtatt

SEQ ID NO: 10066649 - DNA, 22 bp, Homo sapiens
ttcagaaatgtcagccatcaga

SEQ ID NO: 10066650 - DNA, 22 bp, Homo sapiens
ttcagaatatccgtttaagttt

SEQ ID NO: 10066651 - DNA, 22 bp, Homo sapiens
ttcagaatattattttaaaggc

SEQ ID NO: 10066652 - DNA, 22 bp, Homo sapiens
ttcagaataactttttattgaa

SEQ ID NO: 10066653 - DNA, 22 bp, Homo sapiens
ttcagacacagcgctgggaaat

SEQ ID NO: 10066654 - DNA, 22 bp, Homo sapiens
ttcagacaggcagctgggctgg

SEQ ID NO: 10066655 - DNA, 22 bp, Homo sapiens
tcctctggaacctcacccttgc

SEQ ID NO: 10066656 - DNA, 22 bp, Homo sapiens
tcctctggcccagctgcctctg

SEQ ID NO: 10066657 - DNA, 21 bp, Homo sapiens
tcctctactgagccatgcaga

SEQ ID NO: 10066658 - DNA, 22 bp, Homo sapiens
tcctctccagcaaactggctat

SEQ ID NO: 10066659 - DNA, 22 bp, Homo sapiens
tcctctgctccatctttactgt

SEQ ID NO: 10066660 - DNA, 22 bp, Homo sapiens
tcctctgctccaggctggactt

SEQ ID NO: 10066661 - DNA, 22 bp, Homo sapiens
ttctcctacttaaggccttcca

SEQ ID NO: 10066662 - DNA, 22 bp, Homo sapiens
ttctcctctgttaccttgcaaa

SEQ ID NO: 10066663 - DNA, 20 bp, Homo sapiens
ttctgcctagggttagcctg

SEQ ID NO: 10066664 - DNA, 22 bp, Homo sapiens
ttctgcctgatgtagtcatacc

SEQ ID NO: 10066665 - DNA, 22 bp, Homo sapiens
ttctgccacgagcagtttcttc

SEQ ID NO: 10066666 - DNA, 22 bp, Homo sapiens
ttctgccagggaattctgctta

SEQ ID NO: 10066667 - DNA, 19 bp, Homo sapiens
ttctccaggctgcagaggg

SEQ ID NO: 10066668 - DNA, 18 bp, Homo sapiens
ttgagaaataagcactaa

SEQ ID NO: 10066669 - DNA, 22 bp, Homo sapiens
ttcttcctcagcagggctgcct

SEQ ID NO: 10066670 - DNA, 22 bp, Homo sapiens
ttcttccttggtttcctggata

SEQ ID NO: 10066671 - DNA, 22 bp, Homo sapiens
ttctttgcccatgtttcctaag

SEQ ID NO: 10066672 - DNA, 22 bp, Homo sapiens
ttcttctctcatagattaaggt

SEQ ID NO: 10066673 - DNA, 22 bp, Homo sapiens
ttggaatagggaatcaaagttt

SEQ ID NO: 10066674 - DNA, 22 bp, Homo sapiens
ttgcttccttgagctggtctga

SEQ ID NO: 10066675 - DNA, 22 bp, Homo sapiens
ttgtgcagctataaagaaatgg

SEQ ID NO: 10066676 - DNA, 22 bp, Homo sapiens
ttggggtcccacaggctgcctg

SEQ ID NO: 10066677 - DNA, 22 bp, Homo sapiens
ttggcttcttgtgaaatctgag

SEQ ID NO: 10066678 - DNA, 22 bp, Homo sapiens
tttcctttgggcacccgagctc

SEQ ID NO: 10066679 - DNA, 22 bp, Homo sapiens
aggcctccagctgagttttgct

SEQ ID NO: 10066680 - DNA, 22 bp, Homo sapiens
aggcctcctggctccaggcctt

SEQ ID NO: 10066681 - DNA, 23 bp, Homo sapiens
ccaggcagtagctattgaagtga

SEQ ID NO: 10066682 - DNA, 21 bp, Homo sapiens
ccaggcatgactgcagagagc

SEQ ID NO: 10066683 - DNA, 22 bp, Homo sapiens
ccaggcatccattgcttcctct

SEQ ID NO: 10066684 - DNA, 22 bp, Homo sapiens
ccaggcagtcagggttgtgtgt

SEQ ID NO: 10066685 - DNA, 22 bp, Homo sapiens
ccaggctctgagcctcactctt

SEQ ID NO: 10066686 - DNA, 22 bp, Homo sapiens
ccaggctctgagaggaatgtga

SEQ ID NO: 10066687 - DNA, 22 bp, Homo sapiens
ccaggctctgacatagatggga

SEQ ID NO: 10066688 - DNA, 22 bp, Homo sapiens
ccaggctctgcgctggacatgg

SEQ ID NO: 10066689 - DNA, 22 bp, Homo sapiens
ccaggctctgccaggcccttga

SEQ ID NO: 10066690 - DNA, 15 bp, Homo sapiens
ccaggctctgcactc

SEQ ID NO: 10066691 - DNA, 22 bp, Homo sapiens
ccaggctctgcaaaatcaggct

SEQ ID NO: 10066692 - DNA, 22 bp, Homo sapiens
ccaggctctatccctccttctt

SEQ ID NO: 10066693 - DNA, 22 bp, Homo sapiens
ccaggcctagcccctgagggta

SEQ ID NO: 10066694 - DNA, 22 bp, Homo sapiens
aggcagtggagctggaataggc

SEQ ID NO: 10066695 - DNA, 22 bp, Homo sapiens
aggccagcgctgctagctcccg

SEQ ID NO: 10066696 - DNA, 22 bp, Homo sapiens
aggccagctcaccctggctcct

SEQ ID NO: 10066697 - DNA, 22 bp, Homo sapiens
aggccaagattttggatcagct

SEQ ID NO: 10066698 - DNA, 22 bp, Homo sapiens
agggagctttcaggtagcttaa

SEQ ID NO: 10066699 - DNA, 22 bp, Homo sapiens
agggagccagagttgggagctc

SEQ ID NO: 10066700 - DNA, 22 bp, Homo sapiens
cccagcacaggcaattccatac

SEQ ID NO: 10066701 - DNA, 22 bp, Homo sapiens
cccagcaaggccagctcagggc

SEQ ID NO: 10066702 - DNA, 22 bp, Homo sapiens
cccagcctggtgcactgtgggg

SEQ ID NO: 10066703 - DNA, 22 bp, Homo sapiens
cccagcctctgggctcacccaa

SEQ ID NO: 10066704 - DNA, 22 bp, Homo sapiens
cctccaggccttgcaggttaac

SEQ ID NO: 10066705 - DNA, 22 bp, Homo sapiens
cctccaggctggttatcagctg

SEQ ID NO: 10066706 - DNA, 23 bp, Homo sapiens
cctcccaggctgcgagtcccgag

SEQ ID NO: 10066707 - DNA, 20 bp, Homo sapiens
cctccaggcacacccatgtg

SEQ ID NO: 10066708 - DNA, 22 bp, Homo sapiens
cctccaggataagtcagggcct

SEQ ID NO: 10066709 - DNA, 22 bp, Homo sapiens
cctcccagtgcctccagagcag

SEQ ID NO: 10066710 - DNA, 22 bp, Homo sapiens
cctctccttgcacccgtcccgc

SEQ ID NO: 10066711 - DNA, 22 bp, Homo sapiens
cctctctccaattttcacctca

SEQ ID NO: 10066712 - DNA, 22 bp, Homo sapiens
cctcagactcagtgcgttgtga

SEQ ID NO: 10066713 - DNA, 22 bp, Homo sapiens
cctcagacttgataattgggtt

SEQ ID NO: 10066714 - DNA, 22 bp, Homo sapiens
cctcagacgcaggcctatgggc

SEQ ID NO: 10066715 - DNA, 22 bp, Homo sapiens
cctcagaccccacagggcctgt

SEQ ID NO: 10066716 - DNA, 22 bp, Homo sapiens
cctcagagccatgcctgagttc

SEQ ID NO: 10066717 - DNA, 22 bp, Homo sapiens
cctcagagcagcacccagatga

SEQ ID NO: 10066718 - DNA, 22 bp, Homo sapiens
agggccagggaaacgatcagca

SEQ ID NO: 10066719 - DNA, 22 bp, Homo sapiens
agggccagccgacttccagcct

SEQ ID NO: 10066720 - DNA, 22 bp, Homo sapiens
agctgaggctctgagagggaag

SEQ ID NO: 10066721 - DNA, 22 bp, Homo sapiens
agctgaggcatggacaggctgc

SEQ ID NO: 10066722 - DNA, 22 bp, Homo sapiens
agctgaggccacgagtgaaggg

SEQ ID NO: 10066723 - DNA, 18 bp, Homo sapiens
agctctcccccacatgcc

SEQ ID NO: 10066724 - DNA, 22 bp, Homo sapiens
cagcttcttagtctttccttgt

SEQ ID NO: 10066725 - DNA, 22 bp, Homo sapiens
caggaggtgccctctagtggca

SEQ ID NO: 10066726 - DNA, 22 bp, Homo sapiens
agctggcttctctgcagacatt

SEQ ID NO: 10066727 - DNA, 22 bp, Homo sapiens
caggcctggagtgcaatggcac

SEQ ID NO: 10066728 - DNA, 22 bp, Homo sapiens
caggcctcaggggctcaggctg

SEQ ID NO: 10066729 - DNA, 22 bp, Homo sapiens
agctgggaagactggaagacag

SEQ ID NO: 10066730 - DNA, 22 bp, Homo sapiens
agcttgggtgtgcctgcgagct

SEQ ID NO: 10066731 - DNA, 22 bp, Homo sapiens
cagggccagccgcagcatccac

SEQ ID NO: 10066732 - DNA, 22 bp, Homo sapiens
cagggccagagagggctggctg

SEQ ID NO: 10066733 - DNA, 22 bp, Homo sapiens
cagggccagcgtctcgggctat

SEQ ID NO: 10066734 - DNA, 22 bp, Homo sapiens
aggaacctaagagcctgcagtc

SEQ ID NO: 10066735 - DNA, 22 bp, Homo sapiens
aggaggaggtaagaaaagcata

SEQ ID NO: 10066736 - DNA, 22 bp, Homo sapiens
aggagctgacttgtaaagcatt

SEQ ID NO: 10066737 - DNA, 22 bp, Homo sapiens
aggaggaaggcttcattaggtt

SEQ ID NO: 10066738 - DNA, 22 bp, Homo sapiens
aggagctgtgaatgggaggggt

SEQ ID NO: 10066739 - DNA, 22 bp, Homo sapiens
aggacagcatatgggaaccagt

SEQ ID NO: 10066740 - DNA, 22 bp, Homo sapiens
aggacagcccttgagagcacat

SEQ ID NO: 10066741 - DNA, 22 bp, Homo sapiens
aggacagcattttcagcatctc

SEQ ID NO: 10066742 - DNA, 22 bp, Homo sapiens
aggcacagcctcccttcacatg

SEQ ID NO: 10066743 - DNA, 22 bp, Homo sapiens
catgcacagagcttggtcattg

SEQ ID NO: 10066744 - DNA, 22 bp, Homo sapiens
catgcacagtgatatctgaaga

SEQ ID NO: 10066745 - DNA, 22 bp, Homo sapiens
catgcacatgcaatagtgcttt

SEQ ID NO: 10066746 - DNA, 22 bp, Homo sapiens
aggcagcatttgaatccaggtc

SEQ ID NO: 10066747 - DNA, 19 bp, Homo sapiens
aggcagaggcttggctagc

SEQ ID NO: 10066748 - DNA, 22 bp, Homo sapiens
ctctcccagtcaggctcaggat

SEQ ID NO: 10066749 - DNA, 22 bp, Homo sapiens
ctctcccagtcaggctcaggat

SEQ ID NO: 10066750 - DNA, 22 bp, Homo sapiens
ctctccattccctacagttttc

SEQ ID NO: 10066751 - DNA, 20 bp, Homo sapiens
ctctcccagcacagcttcct

SEQ ID NO: 10066752 - DNA, 22 bp, Homo sapiens
ctctccttgcagatggctgcct

SEQ ID NO: 10066753 - DNA, 20 bp, Homo sapiens
ctctccttgccgacttggca

SEQ ID NO: 10066754 - DNA, 22 bp, Homo sapiens
ctctccttgaggcttggacttc

SEQ ID NO: 10066755 - DNA, 22 bp, Homo sapiens
ctctcctttactgcagagagcg

SEQ ID NO: 10066756 - DNA, 22 bp, Homo sapiens
ctctcctttcactaaatattct

SEQ ID NO: 10066757 - DNA, 22 bp, Homo sapiens
ctctcctttgaagcaactgtat

SEQ ID NO: 10066758 - DNA, 22 bp, Homo sapiens
ctcttgggtgggcagtgggcct

SEQ ID NO: 10066759 - DNA, 22 bp, Homo sapiens
agtggtgaggggcatgtgtgat

SEQ ID NO: 10066760 - DNA, 22 bp, Homo sapiens
agtgggactgctatgacagaag

SEQ ID NO: 10066761 - DNA, 21 bp, Homo sapiens
agtgggacacctaagagattt

SEQ ID NO: 10066762 - DNA, 21 bp, Homo sapiens
ctcagaccacagctcacaccc

SEQ ID NO: 10066763 - DNA, 22 bp, Homo sapiens
ctcaccagacatggaacctgtc

SEQ ID NO: 10066764 - DNA, 22 bp, Homo sapiens
agtcccagctactcaagaggct

SEQ ID NO: 10066765 - DNA, 22 bp, Homo sapiens
ctccagaattgtccattggaaa

SEQ ID NO: 10066766 - DNA, 22 bp, Homo sapiens
agtgacaggaccaggtctggaa

SEQ ID NO: 10066767 - DNA, 22 bp, Homo sapiens
agtgacagggaaggataggatt

SEQ ID NO: 10066768 - DNA, 21 bp, Homo sapiens
agtgacagaggaaggtgcata

SEQ ID NO: 10066769 - DNA, 22 bp, Homo sapiens
agtgacagattaccggcagagc

SEQ ID NO: 10066770 - DNA, 22 bp, Homo sapiens
agtgacagctgggaaggtgaaa

SEQ ID NO: 10066771 - DNA, 22 bp, Homo sapiens
agtgacagaggcaggcctgtgg

SEQ ID NO: 10066772 - DNA, 18 bp, Homo sapiens
agtctcagcggaggagta

SEQ ID NO: 10066773 - DNA, 22 bp, Homo sapiens
agtctcagagtacctgagggac

SEQ ID NO: 10066774 - DNA, 22 bp, Homo sapiens
ctcaggccaataagctccagcc

SEQ ID NO: 10066775 - DNA, 22 bp, Homo sapiens
ctcagggaattgaatctccttg

SEQ ID NO: 10066776 - DNA, 22 bp, Homo sapiens
cctgccctaatccagagactag

SEQ ID NO: 10066777 - DNA, 22 bp, Homo sapiens
cctctctcttgtagtccctgcc

SEQ ID NO: 10066778 - DNA, 22 bp, Homo sapiens
cctctgagtgacagcctcctct

SEQ ID NO: 10066779 - DNA, 22 bp, Homo sapiens
aggtgggaacccagcagggccc

SEQ ID NO: 10066780 - DNA, 21 bp, Homo sapiens
aggtgggagaccatgtaggtc

SEQ ID NO: 10066781 - DNA, 22 bp, Homo sapiens
cggctcagacttcccaagaaca

SEQ ID NO: 10066782 - DNA, 20 bp, Homo sapiens
cggctcagcctctccctccc

SEQ ID NO: 10066783 - DNA, 22 bp, Homo sapiens
ctgaggcaggggcagctggaga

SEQ ID NO: 10066784 - DNA, 19 bp, Homo sapiens
agttggggcagggaagaga

SEQ ID NO: 10066785 - DNA, 22 bp, Homo sapiens
ctgctctgctgatcagtgtctc

SEQ ID NO: 10066786 - DNA, 22 bp, Homo sapiens
ctgctctggcgtactcggcatc

SEQ ID NO: 10066787 - DNA, 22 bp, Homo sapiens
atacagagggtttcatgggcag

SEQ ID NO: 10066788 - DNA, 22 bp, Homo sapiens
ctgggagacgcagctggggatc

SEQ ID NO: 10066789 - DNA, 22 bp, Homo sapiens
ctgggacacccaaggaaagagc

SEQ ID NO: 10066790 - DNA, 22 bp, Homo sapiens
ctgggtcccctcagtgacactg

SEQ ID NO: 10066791 - DNA, 22 bp, Homo sapiens
atcctcagacctcagcaaagcc

SEQ ID NO: 10066792 - DNA, 22 bp, Homo sapiens
atccaaagccctaagttaactg

SEQ ID NO: 10066793 - DNA, 22 bp, Homo sapiens
gagctgggcctcagaacacagt

SEQ ID NO: 10066794 - DNA, 22 bp, Homo sapiens
gagctgggcctgcgagtgctgc

SEQ ID NO: 10066795 - DNA, 22 bp, Homo sapiens
atggggctgggattctcctcgg

SEQ ID NO: 10066796 - DNA, 22 bp, Homo sapiens
gaggccaggggcctggagatga

SEQ ID NO: 10066797 - DNA, 22 bp, Homo sapiens
gaggcctggctctgccctcctg

SEQ ID NO: 10066798 - DNA, 22 bp, Homo sapiens
gagccagctatgtagcaagagg

SEQ ID NO: 10066799 - DNA, 22 bp, Homo sapiens
atggcccaggcaggctggtact

SEQ ID NO: 10066800 - DNA, 22 bp, Homo sapiens
atggcccaggccaggatccagc

SEQ ID NO: 10066801 - DNA, 22 bp, Homo sapiens
atggcccaggcctcctgtggct

SEQ ID NO: 10066802 - DNA, 20 bp, Homo sapiens
atggcagtccgtgttcaggg

SEQ ID NO: 10066803 - DNA, 22 bp, Homo sapiens
gagaacaaggaagagtcggcag

SEQ ID NO: 10066804 - DNA, 22 bp, Homo sapiens
gacactgaggcatgcagagccg

SEQ ID NO: 10066805 - DNA, 22 bp, Homo sapiens
atgaaaagcataaacgctgaag

SEQ ID NO: 10066806 - DNA, 22 bp, Homo sapiens
cttgttgcaaacattcactcca

SEQ ID NO: 10066807 - DNA, 22 bp, Homo sapiens
cttgttgctaacatatgcttct

SEQ ID NO: 10066808 - DNA, 22 bp, Homo sapiens
atgaaatgagtcaatgcgacta

SEQ ID NO: 10066809 - DNA, 20 bp, Homo sapiens
cttgagttcagagctgtcat

SEQ ID NO: 10066810 - DNA, 22 bp, Homo sapiens
cttgctgagataaatgctgtct

SEQ ID NO: 10066811 - DNA, 22 bp, Homo sapiens
cttgctgccagccaccatactg

SEQ ID NO: 10066812 - DNA, 22 bp, Homo sapiens
cttgctgcccaggaatacagtc

SEQ ID NO: 10066813 - DNA, 22 bp, Homo sapiens
cttgctgctctggagtcatgcc

SEQ ID NO: 10066814 - DNA, 22 bp, Homo sapiens
cttgctgctgcatctgagcatg

SEQ ID NO: 10066815 - DNA, 22 bp, Homo sapiens
cttgctgcttgtaagtaaaaca

SEQ ID NO: 10066816 - DNA, 19 bp, Homo sapiens
cttggtgcttgcccttggc

SEQ ID NO: 10066817 - DNA, 22 bp, Homo sapiens
cttggtcctgcagggtctcttg

SEQ ID NO: 10066818 - DNA, 22 bp, Homo sapiens
cttggtccgagggcgcctaggc

SEQ ID NO: 10066819 - DNA, 22 bp, Homo sapiens
atgcaaagcaccacactaagat

SEQ ID NO: 10066820 - DNA, 22 bp, Homo sapiens
atgcacagtaatgagctggttg

SEQ ID NO: 10066821 - DNA, 22 bp, Homo sapiens
atgagttagtttcttgtctaga

SEQ ID NO: 10066822 - DNA, 22 bp, Homo sapiens
attggaaatacagtagaaaaat

SEQ ID NO: 10066823 - DNA, 21 bp, Homo sapiens
attggaaaaggtagttggctt

SEQ ID NO: 10066824 - DNA, 21 bp, Homo sapiens
gcctcaccatgtcaagccagg

SEQ ID NO: 10066825 - DNA, 22 bp, Homo sapiens
gcctcactgcagccccaggaag

SEQ ID NO: 10066826 - DNA, 22 bp, Homo sapiens
gcctctccgagccactgcctct

SEQ ID NO: 10066827 - DNA, 22 bp, Homo sapiens
gcctccccaaagtgctgacagc

SEQ ID NO: 10066828 - DNA, 18 bp, Homo sapiens
gcctgcctagagcttgcc

SEQ ID NO: 10066829 - DNA, 22 bp, Homo sapiens
gcctctctgggctgccgaggct

SEQ ID NO: 10066830 - DNA, 22 bp, Homo sapiens
gcctgctgaagccagagtgtgt

SEQ ID NO: 10066831 - DNA, 22 bp, Homo sapiens
gcctgctggatgtggccaggcc

SEQ ID NO: 10066832 - DNA, 22 bp, Homo sapiens
gcctgctgccaccctggctccg

SEQ ID NO: 10066833 - DNA, 22 bp, Homo sapiens
gcctgctgcatccaggctattg

SEQ ID NO: 10066834 - DNA, 22 bp, Homo sapiens
gcctgctggaggagcctcaggg

SEQ ID NO: 10066835 - DNA, 22 bp, Homo sapiens
gcctgctggctgtccattgcag

SEQ ID NO: 10066836 - DNA, 22 bp, Homo sapiens
caaaggcaacatatacttgttt

SEQ ID NO: 10066837 - DNA, 22 bp, Homo sapiens
ggaggccttgaggccaggagct

SEQ ID NO: 10066838 - DNA, 22 bp, Homo sapiens
ggaggccttgcctgcaggcaca

SEQ ID NO: 10066839 - DNA, 22 bp, Homo sapiens
cacactcattagtcatttctct

SEQ ID NO: 10066840 - DNA, 22 bp, Homo sapiens
cacagctggtgacagagcccag

SEQ ID NO: 10066841 - DNA, 22 bp, Homo sapiens
cacagggaggcagccatgctcc

SEQ ID NO: 10066842 - DNA, 22 bp, Homo sapiens
cacagggaggcggtcactggct

SEQ ID NO: 10066843 - DNA, 22 bp, Homo sapiens
cacagggcaccagttggccatc

SEQ ID NO: 10066844 - DNA, 22 bp, Homo sapiens
cacagggcaggccccaggcctc

SEQ ID NO: 10066845 - DNA, 22 bp, Homo sapiens
ggcacagggagaggcggatttt

SEQ ID NO: 10066846 - DNA, 22 bp, Homo sapiens
ggcacagggggctgaggactag

SEQ ID NO: 10066847 - DNA, 22 bp, Homo sapiens
ggcacagggagccgcagttgca

SEQ ID NO: 10066848 - DNA, 22 bp, Homo sapiens
ggcacagggagccgcagttgca

SEQ ID NO: 10066849 - DNA, 22 bp, Homo sapiens
ggcagagatgtgggtcagaatc

SEQ ID NO: 10066850 - DNA, 22 bp, Homo sapiens
ggcagtggttagaaacatgagc

SEQ ID NO: 10066851 - DNA, 18 bp, Homo sapiens
caccctccgcggctgccc

SEQ ID NO: 10066852 - DNA, 22 bp, Homo sapiens
caccctccagctcccgggggct

SEQ ID NO: 10066853 - DNA, 22 bp, Homo sapiens
ggcctcgcggcttctggtggct

SEQ ID NO: 10066854 - DNA, 22 bp, Homo sapiens
gctcctcttctcccactgaatg

SEQ ID NO: 10066855 - DNA, 22 bp, Homo sapiens
gctgcagagtgatgaagtgggg

SEQ ID NO: 10066856 - DNA, 22 bp, Homo sapiens
cacaccagcatggtctcagtgt

SEQ ID NO: 10066857 - DNA, 22 bp, Homo sapiens
gcttggctgcctttggatgttg

SEQ ID NO: 10066858 - DNA, 22 bp, Homo sapiens
gcttctcctcccgctcccaggc

SEQ ID NO: 10066859 - DNA, 20 bp, Homo sapiens
gctgtggccgtgccagactc

SEQ ID NO: 10066860 - DNA, 22 bp, Homo sapiens
gctgtggcctccagcactcccc

SEQ ID NO: 10066861 - DNA, 22 bp, Homo sapiens
gctgtggccgggcccaggccgc

SEQ ID NO: 10066862 - DNA, 22 bp, Homo sapiens
gcttctccagaccttcatcccc

SEQ ID NO: 10066863 - DNA, 22 bp, Homo sapiens
gctgtctgagaacatggtggaa

SEQ ID NO: 10066864 - DNA, 22 bp, Homo sapiens
gctgtctgcaagccaggaaatg

SEQ ID NO: 10066865 - DNA, 19 bp, Homo sapiens
gctgtctgatgctgaggtc

SEQ ID NO: 10066866 - DNA, 18 bp, Homo sapiens
gctgtctgaggtctgagg

SEQ ID NO: 10066867 - DNA, 22 bp, Homo sapiens
gctgtctgagtaagagaatcct

SEQ ID NO: 10066868 - DNA, 22 bp, Homo sapiens
caaggcagctattgtctccata

SEQ ID NO: 10066869 - DNA, 22 bp, Homo sapiens
cactggcccataaaggcctggg

SEQ ID NO: 10066870 - DNA, 22 bp, Homo sapiens
cactggcccagccaggcctgtt

SEQ ID NO: 10066871 - DNA, 22 bp, Homo sapiens
cactgggacctaggactgagct

SEQ ID NO: 10066872 - DNA, 21 bp, Homo sapiens
gggacaccaactccagggctt

SEQ ID NO: 10066873 - DNA, 19 bp, Homo sapiens
gggagcaggaaagctgtgg

SEQ ID NO: 10066874 - DNA, 22 bp, Homo sapiens
cagaggtgtacagagggaggcc

SEQ ID NO: 10066875 - DNA, 22 bp, Homo sapiens
cagaggcttcaagtcattctcc

SEQ ID NO: 10066876 - DNA, 22 bp, Homo sapiens
cagagccctgcatgctccatct

SEQ ID NO: 10066877 - DNA, 22 bp, Homo sapiens
cagagccctgggcacatggtag

SEQ ID NO: 10066878 - DNA, 22 bp, Homo sapiens
cagagcccctcgtctccaccac

SEQ ID NO: 10066879 - DNA, 22 bp, Homo sapiens
cagagcccttcctcccacgggg

SEQ ID NO: 10066880 - DNA, 22 bp, Homo sapiens
cagagcccatttctttgttcct

SEQ ID NO: 10066881 - DNA, 22 bp, Homo sapiens
cagagcccatggcacatgtgga

SEQ ID NO: 10066882 - DNA, 19 bp, Homo sapiens
gggcagaatggcatctcag

SEQ ID NO: 10066883 - DNA, 22 bp, Homo sapiens
gggcacagcccagtggggtccc

SEQ ID NO: 10066884 - DNA, 22 bp, Homo sapiens
gggcacagaagtctaagacatc

SEQ ID NO: 10066885 - DNA, 22 bp, Homo sapiens
ggggaacaccgggcagaggcgc

SEQ ID NO: 10066886 - DNA, 23 bp, Homo sapiens
ggggaaagaccatgcttgaggac

SEQ ID NO: 10066887 - DNA, 22 bp, Homo sapiens
ggttccccaggcggcccttgga

SEQ ID NO: 10066888 - DNA, 22 bp, Homo sapiens
ggtggggtatttggtacttgta

SEQ ID NO: 10066889 - DNA, 22 bp, Homo sapiens
ggtggggttttaggctgctgca

SEQ ID NO: 10066890 - DNA, 22 bp, Homo sapiens
ggtgggggagacttggtcaaga

SEQ ID NO: 10066891 - DNA, 22 bp, Homo sapiens
cagcagcctcaagtttattttc

SEQ ID NO: 10066892 - DNA, 22 bp, Homo sapiens
cagcagcctagggttccatcat

SEQ ID NO: 10066893 - DNA, 22 bp, Homo sapiens
cagcagagtttggcttctaatg

SEQ ID NO: 10066894 - DNA, 22 bp, Homo sapiens
cagcagagtaattctcacctct

SEQ ID NO: 10066895 - DNA, 21 bp, Homo sapiens
cagcagagtaatgcattcgta

SEQ ID NO: 10066896 - DNA, 22 bp, Homo sapiens
cagccacttcgagcttcctgat

SEQ ID NO: 10066897 - DNA, 22 bp, Homo sapiens
cagcccagagccagttcccgct

SEQ ID NO: 10066898 - DNA, 22 bp, Homo sapiens
cagcccagcactaagtagattt

SEQ ID NO: 10066899 - DNA, 22 bp, Homo sapiens
cagcccagcagactgttaccac

SEQ ID NO: 10066900 - DNA, 22 bp, Homo sapiens
cagcccagcagtcttagcctgc

SEQ ID NO: 10066901 - DNA, 21 bp, Homo sapiens
cagcccagcccattgacagtg

SEQ ID NO: 10066902 - DNA, 22 bp, Homo sapiens
cagcccagcagggtctggccct

SEQ ID NO: 10066903 - DNA, 22 bp, Homo sapiens
agaatgtgtgcaagcaagtgtg

SEQ ID NO: 10066904 - DNA, 22 bp, Homo sapiens
agaatgtgggggaaaagagtgt

SEQ ID NO: 10066905 - DNA, 22 bp, Homo sapiens
agacacagtctgtctggaggag

SEQ ID NO: 10066906 - DNA, 22 bp, Homo sapiens
atgcttgcccatgtttctgaag

SEQ ID NO: 10066907 - DNA, 22 bp, Homo sapiens
agagggagtgaaatggaataga

SEQ ID NO: 10066908 - DNA, 22 bp, Homo sapiens
agagtggggaaggtgttgagaa

SEQ ID NO: 10066909 - DNA, 22 bp, Homo sapiens
cagacagaaggctccttgaggt

SEQ ID NO: 10066910 - DNA, 22 bp, Homo sapiens
cagaagcagtgagagatgtgca

SEQ ID NO: 10066911 - DNA, 22 bp, Homo sapiens
agccaagctgatctcctgctga

SEQ ID NO: 10066912 - DNA, 22 bp, Homo sapiens
agccaggtgcagtggcacacac

SEQ ID NO: 10066913 - DNA, 22 bp, Homo sapiens
cagagatggggccagctgctcc

SEQ ID NO: 10066914 - DNA, 22 bp, Homo sapiens
cagagagggcggccctggcttc

SEQ ID NO: 10066915 - DNA, 22 bp, Homo sapiens
agcccaggaagttgaggcttgc

SEQ ID NO: 10066916 - DNA, 22 bp, Homo sapiens
agcccaggaatctgcatcttga

SEQ ID NO: 10066917 - DNA, 22 bp, Homo sapiens
agcccaggaggtggaggttgca

SEQ ID NO: 10066918 - DNA, 22 bp, Homo sapiens
agcccaggagcctttggagggt

SEQ ID NO: 10066919 - DNA, 22 bp, Homo sapiens
cagaggctaagagtgtccaaag

SEQ ID NO: 10066920 - DNA, 22 bp, Homo sapiens
cagcacacagtgactcgcacct

SEQ ID NO: 10066921 - DNA, 22 bp, Homo sapiens
cagcacaggaatatggtggaca

SEQ ID NO: 10066922 - DNA, 22 bp, Homo sapiens
cagcacaggcctgtctttgtct

SEQ ID NO: 10066923 - DNA, 22 bp, Homo sapiens
cagcacagctgaggggctgtct

SEQ ID NO: 10066924 - DNA, 22 bp, Homo sapiens
cagcacaggaagtgggccttca

SEQ ID NO: 10066925 - DNA, 22 bp, Homo sapiens
cagcacagggcttgagaggtgt

SEQ ID NO: 10066926 - DNA, 22 bp, Homo sapiens
agcctccatcccatgcacaaag

SEQ ID NO: 10066927 - DNA, 22 bp, Homo sapiens
cagcagaggtggttcacattgt

SEQ ID NO: 10066928 - DNA, 22 bp, Homo sapiens
agccttccacccagatcccctt

SEQ ID NO: 10066929 - DNA, 22 bp, Homo sapiens
cagcagaggttttgctccatga

SEQ ID NO: 10066930 - DNA, 22 bp, Homo sapiens
agctccctgagatgccacagca

SEQ ID NO: 10066931 - DNA, 22 bp, Homo sapiens
cagccagatcagggcaggggtt

SEQ ID NO: 10066932 - DNA, 22 bp, Homo sapiens
cagccagaggctgcgaggggcc

SEQ ID NO: 10066933 - DNA, 22 bp, Homo sapiens
agctcagaacctcctcatccca

SEQ ID NO: 10066934 - DNA, 22 bp, Homo sapiens
agctcagaaatgccagtaggta

SEQ ID NO: 10066935 - DNA, 22 bp, Homo sapiens
agctcagaactgcagacatgtg

SEQ ID NO: 10066936 - DNA, 22 bp, Homo sapiens
agctcagaagcctatgcatagt

SEQ ID NO: 10066937 - DNA, 22 bp, Homo sapiens
agcaggtgatgtgagtctggaa

SEQ ID NO: 10066938 - DNA, 20 bp, Homo sapiens
agcaggtaaggcacagcagt

SEQ ID NO: 10066939 - DNA, 22 bp, Homo sapiens
agcagggcctggcactcctggg

SEQ ID NO: 10066940 - DNA, 22 bp, Homo sapiens
agcagggctccatttcactgcc

SEQ ID NO: 10066941 - DNA, 22 bp, Homo sapiens
agcagggcagtgcttcagctct

SEQ ID NO: 10066942 - DNA, 22 bp, Homo sapiens
cactctgagcccaagcaggctg

SEQ ID NO: 10066943 - DNA, 22 bp, Homo sapiens
agcaggagagcagtgcgtggtc

SEQ ID NO: 10066944 - DNA, 22 bp, Homo sapiens
agcaggagacatgggggtggtg

SEQ ID NO: 10066945 - DNA, 22 bp, Homo sapiens
cacagggccactttcccagtaa

SEQ ID NO: 10066946 - DNA, 22 bp, Homo sapiens
agcacagatgcatgatcaccag

SEQ ID NO: 10066947 - DNA, 22 bp, Homo sapiens
agcacagactggtcccaggtct

SEQ ID NO: 10066948 - DNA, 22 bp, Homo sapiens
agcagcaagtgtaactgaatat

SEQ ID NO: 10066949 - DNA, 22 bp, Homo sapiens
agcagcaataataaagtaatac

SEQ ID NO: 10066950 - DNA, 22 bp, Homo sapiens
agcagcaaggaacagaatggac

SEQ ID NO: 10066951 - DNA, 22 bp, Homo sapiens
agctgggtccctctgctgatgg

SEQ ID NO: 10066952 - DNA, 22 bp, Homo sapiens
acaggctctggggcaggatggc

SEQ ID NO: 10066953 - DNA, 22 bp, Homo sapiens
acagcagacacaggcacgctgt

SEQ ID NO: 10066954 - DNA, 22 bp, Homo sapiens
acagctcactcacagggctagt

SEQ ID NO: 10066955 - DNA, 22 bp, Homo sapiens
agctggggctgcagagaacagg

SEQ ID NO: 10066956 - DNA, 22 bp, Homo sapiens
agctgggtacagcctgtgccta

SEQ ID NO: 10066957 - DNA, 22 bp, Homo sapiens
agctgggtactgatgtcttcag

SEQ ID NO: 10066958 - DNA, 22 bp, Homo sapiens
agctggggttgcacacattttg

SEQ ID NO: 10066959 - DNA, 22 bp, Homo sapiens
aggcagcatgggcccagagtcc

SEQ ID NO: 10066960 - DNA, 21 bp, Homo sapiens
aggcaggattcaaacacagag

SEQ ID NO: 10066961 - DNA, 21 bp, Homo sapiens
aggaggaacccgtggctgggc

SEQ ID NO: 10066962 - DNA, 22 bp, Homo sapiens
aggagctggagtccaggcaagt

SEQ ID NO: 10066963 - DNA, 22 bp, Homo sapiens
aggagctgttttgttcagcaaa

SEQ ID NO: 10066964 - DNA, 22 bp, Homo sapiens
acaggtggacacagcagcagtc

SEQ ID NO: 10066965 - DNA, 22 bp, Homo sapiens
acagggcacctgaggtaggaag

SEQ ID NO: 10066966 - DNA, 22 bp, Homo sapiens
acagggtggggatggtgagctt

SEQ ID NO: 10066967 - DNA, 22 bp, Homo sapiens
acagggcaacctctgggagact

SEQ ID NO: 10066968 - DNA, 18 bp, Homo sapiens
acagggagggcgctgggg

SEQ ID NO: 10066969 - DNA, 20 bp, Homo sapiens
acatggaaggtcaaactatc

SEQ ID NO: 10066970 - DNA, 22 bp, Homo sapiens
aggcagggctcatttcttaggc

SEQ ID NO: 10066971 - DNA, 22 bp, Homo sapiens
accccaggaagtggaggtcatg

SEQ ID NO: 10066972 - DNA, 23 bp, Homo sapiens
agggcatgaagcagaggacgtgg

SEQ ID NO: 10066973 - DNA, 22 bp, Homo sapiens
agggcatctagttccctctctt

SEQ ID NO: 10066974 - DNA, 22 bp, Homo sapiens
agggcatctctaacagtctcct

SEQ ID NO: 10066975 - DNA, 22 bp, Homo sapiens
agggagctctttggtcttgccg

SEQ ID NO: 10066976 - DNA, 22 bp, Homo sapiens
agggacacgaggtcctgctggg

SEQ ID NO: 10066977 - DNA, 22 bp, Homo sapiens
actgcacacctccagggcacta

SEQ ID NO: 10066978 - DNA, 22 bp, Homo sapiens
actgcacacttagcatctggga

SEQ ID NO: 10066979 - DNA, 22 bp, Homo sapiens
actgcacagaaccttagaatat

SEQ ID NO: 10066980 - DNA, 22 bp, Homo sapiens
actgcacaaggcctggacacac

SEQ ID NO: 10066981 - DNA, 22 bp, Homo sapiens
actgcacacatgtttaagtgga

SEQ ID NO: 10066982 - DNA, 22 bp, Homo sapiens
actgatgagagttagtgctagt

SEQ ID NO: 10066983 - DNA, 22 bp, Homo sapiens
actccaggatgtagaatcagag

SEQ ID NO: 10066984 - DNA, 22 bp, Homo sapiens
actccaggaaacttaggggaaa

SEQ ID NO: 10066985 - DNA, 22 bp, Homo sapiens
actccaggcatctgcttctgct

SEQ ID NO: 10066986 - DNA, 19 bp, Homo sapiens
actccagggatgacagaag

SEQ ID NO: 10066987 - DNA, 22 bp, Homo sapiens
actccagggaggtgagtgtgcg

SEQ ID NO: 10066988 - DNA, 22 bp, Homo sapiens
agtctggatttagaggtgggcc

SEQ ID NO: 10066989 - DNA, 22 bp, Homo sapiens
acctgctcaactggcttctcgc

SEQ ID NO: 10066990 - DNA, 22 bp, Homo sapiens
acctccctggccttctgattcc

SEQ ID NO: 10066991 - DNA, 22 bp, Homo sapiens
acctccctgggttatcggggca

SEQ ID NO: 10066992 - DNA, 22 bp, Homo sapiens
acctccctgcctcttggcgtca

SEQ ID NO: 10066993 - DNA, 22 bp, Homo sapiens
acctgtgtctcctctgtgttct

SEQ ID NO: 10066994 - DNA, 22 bp, Homo sapiens
aggtacatggggtgtgtgcacg

SEQ ID NO: 10066995 - DNA, 21 bp, Homo sapiens
acctccctcgagcaaccagca

SEQ ID NO: 10066996 - DNA, 20 bp, Homo sapiens
acctccctctgtgggtggga

SEQ ID NO: 10066997 - DNA, 22 bp, Homo sapiens
acctccctcgccgtccactctg

SEQ ID NO: 10066998 - DNA, 22 bp, Homo sapiens
acctccctaacccttttggctc

SEQ ID NO: 10066999 - DNA, 22 bp, Homo sapiens
acctccctaagggtccagctta

SEQ ID NO: 10067000 - DNA, 22 bp, Homo sapiens
acctccctccatctggacacta

SEQ ID NO: 10067001 - DNA, 22 bp, Homo sapiens
atccagagacccaaggacagaa

SEQ ID NO: 10067002 - DNA, 22 bp, Homo sapiens
atcagcaaggcaatcactgcag

SEQ ID NO: 10067003 - DNA, 22 bp, Homo sapiens
atcagagctgtgattcccactc

SEQ ID NO: 10067004 - DNA, 22 bp, Homo sapiens
actttgggtaagccaggtgcta

SEQ ID NO: 10067005 - DNA, 21 bp, Homo sapiens
actttgggaggtgtgaggggc

SEQ ID NO: 10067006 - DNA, 22 bp, Homo sapiens
actttgggcacagtgaggccag

SEQ ID NO: 10067007 - DNA, 22 bp, Homo sapiens
actttggggatctacggctgga

SEQ ID NO: 10067008 - DNA, 22 bp, Homo sapiens
acttgggatttcagatgctgtg

SEQ ID NO: 10067009 - DNA, 22 bp, Homo sapiens
acttgggatggtggccagagcg

SEQ ID NO: 10067010 - DNA, 22 bp, Homo sapiens
acttgggagggtgtgggcagct

SEQ ID NO: 10067011 - DNA, 22 bp, Homo sapiens
acttgccccagaattgctgctg

SEQ ID NO: 10067012 - DNA, 22 bp, Homo sapiens
aactagaacgagaaagctgaac

SEQ ID NO: 10067013 - DNA, 22 bp, Homo sapiens
aatgacagccagattcttctct

SEQ ID NO: 10067014 - DNA, 22 bp, Homo sapiens
aatgacagtggcacagtcactt

SEQ ID NO: 10067015 - DNA, 22 bp, Homo sapiens
aacatctccaacctacatccac

SEQ ID NO: 10067016 - DNA, 22 bp, Homo sapiens
aagtgtaagcaaagctcaagct

SEQ ID NO: 10067017 - DNA, 22 bp, Homo sapiens
aacagagcattctgcactacaa

SEQ ID NO: 10067018 - DNA, 22 bp, Homo sapiens
aatgggaaaagagtatgattta

SEQ ID NO: 10067019 - DNA, 22 bp, Homo sapiens
aatgggaaagagactagatgct

SEQ ID NO: 10067020 - DNA, 22 bp, Homo sapiens
aagagcagattcctagtggagc

SEQ ID NO: 10067021 - DNA, 22 bp, Homo sapiens
aagagcactaacagagctgata

SEQ ID NO: 10067022 - DNA, 22 bp, Homo sapiens
aagagcaggctgctgtggagta

SEQ ID NO: 10067023 - DNA, 22 bp, Homo sapiens
aagagcaggctgctgtggagta

SEQ ID NO: 10067024 - DNA, 22 bp, Homo sapiens
aagcaagaggaaatgtggacct

SEQ ID NO: 10067025 - DNA, 22 bp, Homo sapiens
aagcaagagttggagtgatgtt

SEQ ID NO: 10067026 - DNA, 22 bp, Homo sapiens
aagatgcctgtagcaggaagat

SEQ ID NO: 10067027 - DNA, 22 bp, Homo sapiens
aagcagagcctgagacagggat

SEQ ID NO: 10067028 - DNA, 22 bp, Homo sapiens
acagcagagccagtggctctag

SEQ ID NO: 10067029 - DNA, 22 bp, Homo sapiens
aaagccttttatgatcagttaa

SEQ ID NO: 10067030 - DNA, 22 bp, Homo sapiens
aaaggcagagtgctcagctggc

SEQ ID NO: 10067031 - DNA, 18 bp, Homo sapiens
aaaggcatatatagaagt

SEQ ID NO: 10067032 - DNA, 22 bp, Homo sapiens
aaaggcatctagccaagttgag

SEQ ID NO: 10067033 - DNA, 22 bp, Homo sapiens
aaaggcagtgggtatgtggatc

SEQ ID NO: 10067034 - DNA, 22 bp, Homo sapiens
aaagcacttgaaatctggcagt

SEQ ID NO: 10067035 - DNA, 22 bp, Homo sapiens
aaagcactcggcttcatccagg

SEQ ID NO: 10067036 - DNA, 22 bp, Homo sapiens
aagcctccttattaaaggatat

SEQ ID NO: 10067037 - DNA, 22 bp, Homo sapiens
aagcccagatgggagcatttca

SEQ ID NO: 10067038 - DNA, 22 bp, Homo sapiens
aagcccagatgtgagaactgag

SEQ ID NO: 10067039 - DNA, 22 bp, Homo sapiens
aagcccagatgggagcatttca

SEQ ID NO: 10067040 - DNA, 22 bp, Homo sapiens
aagcaggcattccagagacaat

SEQ ID NO: 10067041 - DNA, 21 bp, Homo sapiens
aaaaggaggcaggtgaacagc

SEQ ID NO: 10067042 - DNA, 22 bp, Homo sapiens
aaaaggatgttttcatgaaaca

SEQ ID NO: 10067043 - DNA, 19 bp, Homo sapiens
aaaaggagagatcagagtt

SEQ ID NO: 10067044 - DNA, 22 bp, Homo sapiens
aaagaacaaattagctgtttta

SEQ ID NO: 10067045 - DNA, 22 bp, Homo sapiens
aaagagcaagctgagatttgaa

SEQ ID NO: 10067046 - DNA, 19 bp, Homo sapiens
agccagggtccagacatgt

SEQ ID NO: 10067047 - DNA, 23 bp, Homo sapiens
acagagactgccaagatattctc

SEQ ID NO: 10067048 - DNA, 22 bp, Homo sapiens
acagagagaaacaatcagcagc

SEQ ID NO: 10067049 - DNA, 23 bp, Homo sapiens
acagagacaatggtttcatcttg

SEQ ID NO: 10067050 - DNA, 22 bp, Homo sapiens
acagagaaagtgggctgaagat

SEQ ID NO: 10067051 - DNA, 22 bp, Homo sapiens
agcctctctgatgtgacagcta

SEQ ID NO: 10067052 - DNA, 22 bp, Homo sapiens
acagagagctgtgattgagtta

SEQ ID NO: 10067053 - DNA, 22 bp, Homo sapiens
agcctcctgtagccctcaccca

SEQ ID NO: 10067054 - DNA, 22 bp, Homo sapiens
agcctctcactgtcaccctccc

SEQ ID NO: 10067055 - DNA, 22 bp, Homo sapiens
acagagccaaaaggacatagta

SEQ ID NO: 10067056 - DNA, 22 bp, Homo sapiens
acagagcatttgggacagagag

SEQ ID NO: 10067057 - DNA, 22 bp, Homo sapiens
acagagccactttggtgcctac

SEQ ID NO: 10067058 - DNA, 21 bp, Homo sapiens
acagagccgggcacaaagctg

SEQ ID NO: 10067059 - DNA, 22 bp, Homo sapiens
agcctctctttattcccagcta

SEQ ID NO: 10067060 - DNA, 22 bp, Homo sapiens
acactctagagggaagcgcttt

SEQ ID NO: 10067061 - DNA, 22 bp, Homo sapiens
acactgagattttcctgacacc

SEQ ID NO: 10067062 - DNA, 18 bp, Homo sapiens
agcagagcccatgcattc

SEQ ID NO: 10067063 - DNA, 22 bp, Homo sapiens
agcagagcatggtgggaagggc

SEQ ID NO: 10067064 - DNA, 22 bp, Homo sapiens
agcagagccaggtctctctgta

SEQ ID NO: 10067065 - DNA, 22 bp, Homo sapiens
agcagagcagatagtattatct

SEQ ID NO: 10067066 - DNA, 17 bp, Homo sapiens
agcagctgggttgatct

SEQ ID NO: 10067067 - DNA, 22 bp, Homo sapiens
agcagctgggctcagagctggg

SEQ ID NO: 10067068 - DNA, 22 bp, Homo sapiens
acacagagtttgacacatggga

SEQ ID NO: 10067069 - DNA, 22 bp, Homo sapiens
acaaaggcaggattgacttagt

SEQ ID NO: 10067070 - DNA, 22 bp, Homo sapiens
acaaaggcatagtgaatgtttt

SEQ ID NO: 10067071 - DNA, 22 bp, Homo sapiens
acaaagaaggaattggtcttta

SEQ ID NO: 10067072 - DNA, 22 bp, Homo sapiens
agaggctctaataccagcatgg

SEQ ID NO: 10067073 - DNA, 22 bp, Homo sapiens
acaagagcttatttccctgttt

SEQ ID NO: 10067074 - DNA, 20 bp, Homo sapiens
acaagagctcagattcagag

SEQ ID NO: 10067075 - DNA, 22 bp, Homo sapiens
acaagaatttacatgtagtgga

SEQ ID NO: 10067076 - DNA, 22 bp, Homo sapiens
acaagcgggccacagtgctggt

SEQ ID NO: 10067077 - DNA, 22 bp, Homo sapiens
acaagcacttcactgtcctctg

SEQ ID NO: 10067078 - DNA, 22 bp, Homo sapiens
agagccaggctctacctgggtt

SEQ ID NO: 10067079 - DNA, 22 bp, Homo sapiens
agagccaggtgtagtctcggag

SEQ ID NO: 10067080 - DNA, 22 bp, Homo sapiens
agagccagttaagcacttacag

SEQ ID NO: 10067081 - DNA, 22 bp, Homo sapiens
agagccagttacaactgtggag

SEQ ID NO: 10067082 - DNA, 22 bp, Homo sapiens
agagccaggctcccatggggca

SEQ ID NO: 10067083 - DNA, 22 bp, Homo sapiens
agagcagtcaggctaggacact

SEQ ID NO: 10067084 - DNA, 22 bp, Homo sapiens
agagccaggcggctgggcacct

SEQ ID NO: 10067085 - DNA, 22 bp, Homo sapiens
agagccagttgttaagcactta

SEQ ID NO: 10067086 - DNA, 22 bp, Homo sapiens
agaagcagaaggaagcagggcc

SEQ ID NO: 10067087 - DNA, 20 bp, Homo sapiens
agacaatgagtgacagagtt

SEQ ID NO: 10067088 - DNA, 22 bp, Homo sapiens
aatggcagaggcaaagatggta

SEQ ID NO: 10067089 - DNA, 22 bp, Homo sapiens
agacaatgtttggtctacactt

SEQ ID NO: 10067090 - DNA, 22 bp, Homo sapiens
aatcaggacccactctacagtt

SEQ ID NO: 10067091 - DNA, 22 bp, Homo sapiens
aatcaggatatgaacccaggta

SEQ ID NO: 10067092 - DNA, 22 bp, Homo sapiens
aatcaggaactcaagtgcattg

SEQ ID NO: 10067093 - DNA, 22 bp, Homo sapiens
aatcagaactcctaccacagag

SEQ ID NO: 10067094 - DNA, 22 bp, Homo sapiens
aatcagaaccttgggtcataac

SEQ ID NO: 10067095 - DNA, 22 bp, Homo sapiens
aatcagaacgctcgatcttcgg

SEQ ID NO: 10067096 - DNA, 22 bp, Homo sapiens
aatcagaaattgagggtctggt

SEQ ID NO: 10067097 - DNA, 22 bp, Homo sapiens
aatcagaaattctacatcacaa

SEQ ID NO: 10067098 - DNA, 22 bp, Homo sapiens
aatcagaatcagttgacacagc

SEQ ID NO: 10067099 - DNA, 22 bp, Homo sapiens
aatcagaacttctcagggtggg

SEQ ID NO: 10067100 - DNA, 15 bp, Homo sapiens
aatcagaagtgtggc

SEQ ID NO: 10067101 - DNA, 22 bp, Homo sapiens
aatcagaatttattgaatcttt

SEQ ID NO: 10067102 - DNA, 22 bp, Homo sapiens
aatcagaatttgtcccctgagt

SEQ ID NO: 10067103 - DNA, 22 bp, Homo sapiens
agaacaatgttaaattattaag

SEQ ID NO: 10067104 - DNA, 22 bp, Homo sapiens
agaacaatgcgtattttactcc

SEQ ID NO: 10067105 - DNA, 20 bp, Homo sapiens
agaacaagtactaaaggaga

SEQ ID NO: 10067106 - DNA, 19 bp, Homo sapiens
aatcagaaatatcgaggcc

SEQ ID NO: 10067107 - DNA, 20 bp, Homo sapiens
aatcagaaagtgtgagctct

SEQ ID NO: 10067108 - DNA, 22 bp, Homo sapiens
aatcagaaagatcttgatgaga

SEQ ID NO: 10067109 - DNA, 22 bp, Homo sapiens
aatcagaaaggctaaggaagca

SEQ ID NO: 10067110 - DNA, 22 bp, Homo sapiens
aatcagaaagaggtcatgttgc

SEQ ID NO: 10067111 - DNA, 22 bp, Homo sapiens
aatcagaaaattcagtggaatt

SEQ ID NO: 10067112 - DNA, 22 bp, Homo sapiens
actcagaagatataatgactca

SEQ ID NO: 10067113 - DNA, 22 bp, Homo sapiens
actcagaatgactgatgctgtg

SEQ ID NO: 10067114 - DNA, 22 bp, Homo sapiens
acctacagagatctgcattttt

SEQ ID NO: 10067115 - DNA, 22 bp, Homo sapiens
acctacagatctttgaatgtgt

SEQ ID NO: 10067116 - DNA, 22 bp, Homo sapiens
acggggctagagaaggtttctt

SEQ ID NO: 10067117 - DNA, 22 bp, Homo sapiens
acggggctagagaaggtttctt

SEQ ID NO: 10067118 - DNA, 22 bp, Homo sapiens
acagggcagagtgaaatgctat

SEQ ID NO: 10067119 - DNA, 22 bp, Homo sapiens
acagggcagagggcagttggta

SEQ ID NO: 10067120 - DNA, 22 bp, Homo sapiens
acagggcagagggcagttggta

SEQ ID NO: 10067121 - DNA, 22 bp, Homo sapiens
acagggcagcaactttgtgcct

SEQ ID NO: 10067122 - DNA, 22 bp, Homo sapiens
acagggcagagaggcaggcttg

SEQ ID NO: 10067123 - DNA, 22 bp, Homo sapiens
acagggcagagaggcaggcttg

SEQ ID NO: 10067124 - DNA, 22 bp, Homo sapiens
acagggcagaaatgttgcatct

SEQ ID NO: 10067125 - DNA, 19 bp, Homo sapiens
acagggcagcaataggata

SEQ ID NO: 10067126 - DNA, 22 bp, Homo sapiens
aagctcagagtctcggagggaa

SEQ ID NO: 10067127 - DNA, 17 bp, Homo sapiens
acagggcagaaacagct

SEQ ID NO: 10067128 - DNA, 22 bp, Homo sapiens
aaggctctctgatggcagcagt

SEQ ID NO: 10067129 - DNA, 22 bp, Homo sapiens
accctgccctctccagctcagg

SEQ ID NO: 10067130 - DNA, 22 bp, Homo sapiens
ggaactgggttagggtctcttc

SEQ ID NO: 10067131 - DNA, 22 bp, Homo sapiens
ggaaggggtgggtgagcctcag

SEQ ID NO: 10067132 - DNA, 22 bp, Homo sapiens
gcttcctggaacaactgttgct

SEQ ID NO: 10067133 - DNA, 22 bp, Homo sapiens
ggagctgagcagcgatggcgga

SEQ ID NO: 10067134 - DNA, 22 bp, Homo sapiens
ggagctgaggctgaggcctcac

SEQ ID NO: 10067135 - DNA, 22 bp, Homo sapiens
ggagctgagacccagtggctga

SEQ ID NO: 10067136 - DNA, 22 bp, Homo sapiens
ggaggagcatgagagggtagtg

SEQ ID NO: 10067137 - DNA, 19 bp, Homo sapiens
ggaggcctgggtatttgcc

SEQ ID NO: 10067138 - DNA, 22 bp, Homo sapiens
ggaggcctggacttcctgatgg

SEQ ID NO: 10067139 - DNA, 22 bp, Homo sapiens
ggaggcctcagtaccttgcttt

SEQ ID NO: 10067140 - DNA, 22 bp, Homo sapiens
ggaggcccagaaggaagcccag

SEQ ID NO: 10067141 - DNA, 22 bp, Homo sapiens
ggaggcctaaggtacagtttgc

SEQ ID NO: 10067142 - DNA, 22 bp, Homo sapiens
ggaggctccactgctcttcctg

SEQ ID NO: 10067143 - DNA, 22 bp, Homo sapiens
ggaggctcagactccatcctca

SEQ ID NO: 10067144 - DNA, 22 bp, Homo sapiens
ggaggctcttatttgttcaaca

SEQ ID NO: 10067145 - DNA, 22 bp, Homo sapiens
ggaggctcgctggtcgcacagc

SEQ ID NO: 10067146 - DNA, 22 bp, Homo sapiens
ggaggctctgccatctgtcaca

SEQ ID NO: 10067147 - DNA, 22 bp, Homo sapiens
ggaggtccatgtgaatgtggcc

SEQ ID NO: 10067148 - DNA, 22 bp, Homo sapiens
ggaggggaggtccagctgatct

SEQ ID NO: 10067149 - DNA, 22 bp, Homo sapiens
ggcaggcattgcaacatgtaca

SEQ ID NO: 10067150 - DNA, 22 bp, Homo sapiens
ggcaggtgcgcatgttgcatta

SEQ ID NO: 10067151 - DNA, 22 bp, Homo sapiens
ggcagctgtctctgagttagca

SEQ ID NO: 10067152 - DNA, 22 bp, Homo sapiens
ggcacagagctttgtcccagtt

SEQ ID NO: 10067153 - DNA, 22 bp, Homo sapiens
ggcacagagttggcagagctgc

SEQ ID NO: 10067154 - DNA, 22 bp, Homo sapiens
ggcacagatagatcaagtgtct

SEQ ID NO: 10067155 - DNA, 23 bp, Homo sapiens
ggcacagatgctgagcatgtgca

SEQ ID NO: 10067156 - DNA, 21 bp, Homo sapiens
ggcagagaagctggaagttgg

SEQ ID NO: 10067157 - DNA, 22 bp, Homo sapiens
ggcagagacaccgaatgactct

SEQ ID NO: 10067158 - DNA, 22 bp, Homo sapiens
ggcagagcttgcagtgagccga

SEQ ID NO: 10067159 - DNA, 22 bp, Homo sapiens
ggagtgggaacaatgacatggt

SEQ ID NO: 10067160 - DNA, 22 bp, Homo sapiens
ggagtgtggagaggacatgggt

SEQ ID NO: 10067161 - DNA, 22 bp, Homo sapiens
gggcagaggttcaacttcaaca

SEQ ID NO: 10067162 - DNA, 22 bp, Homo sapiens
gggcgtggatggtcagtgcagg

SEQ ID NO: 10067163 - DNA, 22 bp, Homo sapiens
gggatggggagctggaaagggg

SEQ ID NO: 10067164 - DNA, 22 bp, Homo sapiens
gggaggctggctctggccacag

SEQ ID NO: 10067165 - DNA, 22 bp, Homo sapiens
gggaggctctgctcagcccccg

SEQ ID NO: 10067166 - DNA, 22 bp, Homo sapiens
gggaccagtgtctgtgagaaaa

SEQ ID NO: 10067167 - DNA, 22 bp, Homo sapiens
gggacctgggccagaggacagt

SEQ ID NO: 10067168 - DNA, 22 bp, Homo sapiens
gggacgacaggctctgtggtag

SEQ ID NO: 10067169 - DNA, 22 bp, Homo sapiens
gggagaactgggtggagcatct

SEQ ID NO: 10067170 - DNA, 22 bp, Homo sapiens
gggctggaagacaggaaatgct

SEQ ID NO: 10067171 - DNA, 22 bp, Homo sapiens
gggctggacatctaaggtagct

SEQ ID NO: 10067172 - DNA, 22 bp, Homo sapiens
ggggacagtcgatctagtgatt

SEQ ID NO: 10067173 - DNA, 23 bp, Homo sapiens
ggggacagttcccactggggtct

SEQ ID NO: 10067174 - DNA, 17 bp, Homo sapiens
gggctggatggccatgg

SEQ ID NO: 10067175 - DNA, 22 bp, Homo sapiens
gggctggatgggagccttggcc

SEQ ID NO: 10067176 - DNA, 22 bp, Homo sapiens
ggggaccttcccagagcagttg

SEQ ID NO: 10067177 - DNA, 22 bp, Homo sapiens
gggggtaggcagacaaggacat

SEQ ID NO: 10067178 - DNA, 22 bp, Homo sapiens
gggggtcccaagctgggctgct

SEQ ID NO: 10067179 - DNA, 22 bp, Homo sapiens
ggggggctgttctggacaggaa

SEQ ID NO: 10067180 - DNA, 22 bp, Homo sapiens
gggtctggacggctgcaggaag

SEQ ID NO: 10067181 - DNA, 23 bp, Homo sapiens
ggcttcagtgagagtccctgctg

SEQ ID NO: 10067182 - DNA, 22 bp, Homo sapiens
gggaacagagtgccagactgac

SEQ ID NO: 10067183 - DNA, 22 bp, Homo sapiens
gggaacagcatatctgaagggt

SEQ ID NO: 10067184 - DNA, 22 bp, Homo sapiens
gggaacagggcctgagctgggg

SEQ ID NO: 10067185 - DNA, 22 bp, Homo sapiens
gggaacagaggagggtgttgct

SEQ ID NO: 10067186 - DNA, 22 bp, Homo sapiens
ggccttgggaggagggtcagaa

SEQ ID NO: 10067187 - DNA, 22 bp, Homo sapiens
ggccttggctcctgcagggagt

SEQ ID NO: 10067188 - DNA, 22 bp, Homo sapiens
ggccttggattttaccctaaag

SEQ ID NO: 10067189 - DNA, 22 bp, Homo sapiens
ggccttggatccaagctgcggc

SEQ ID NO: 10067190 - DNA, 22 bp, Homo sapiens
ggccttggcctagccctccagg

SEQ ID NO: 10067191 - DNA, 22 bp, Homo sapiens
ggccttggagtcagccttgagc

SEQ ID NO: 10067192 - DNA, 22 bp, Homo sapiens
ggccagaaagttaagctgtggc

SEQ ID NO: 10067193 - DNA, 22 bp, Homo sapiens
ggcaggtgctgggagcatctca

SEQ ID NO: 10067194 - DNA, 22 bp, Homo sapiens
ggcaggtggaaggtctccattc

SEQ ID NO: 10067195 - DNA, 20 bp, Homo sapiens
ggcaggtgctgtcccctcct

SEQ ID NO: 10067196 - DNA, 22 bp, Homo sapiens
gtgtgcagtctgctaggcaggg

SEQ ID NO: 10067197 - DNA, 22 bp, Homo sapiens
gtgtggggccaggatcagggct

SEQ ID NO: 10067198 - DNA, 22 bp, Homo sapiens
gtgtgcagcagagacaggactc

SEQ ID NO: 10067199 - DNA, 22 bp, Homo sapiens
gtgtgcaggcttgaggattagg

SEQ ID NO: 10067200 - DNA, 22 bp, Homo sapiens
gtgtgcagggggccagcgcagc

SEQ ID NO: 10067201 - DNA, 22 bp, Homo sapiens
gtgggcttcccttaagccagag

SEQ ID NO: 10067202 - DNA, 22 bp, Homo sapiens
gtgggctgcttcctccttccac

SEQ ID NO: 10067203 - DNA, 22 bp, Homo sapiens
gtgggcagcctgtccggagacc

SEQ ID NO: 10067204 - DNA, 22 bp, Homo sapiens
gtgggcagattatagatgatgc

SEQ ID NO: 10067205 - DNA, 22 bp, Homo sapiens
gtgggcagaggagagaacatta

SEQ ID NO: 10067206 - DNA, 22 bp, Homo sapiens
gtgggcagacatgatagaagga

SEQ ID NO: 10067207 - DNA, 22 bp, Homo sapiens
gtggggtagatctttctcagga

SEQ ID NO: 10067208 - DNA, 22 bp, Homo sapiens
gtgggggtggaaaggcaagttg

SEQ ID NO: 10067209 - DNA, 22 bp, Homo sapiens
gtggttagcgccccattcttct

SEQ ID NO: 10067210 - DNA, 22 bp, Homo sapiens
gtggtgtttgagctgccaggga

SEQ ID NO: 10067211 - DNA, 22 bp, Homo sapiens
gtggtgtaggtcacagttagga

SEQ ID NO: 10067212 - DNA, 22 bp, Homo sapiens
gtggtcttactggagggactct

SEQ ID NO: 10067213 - DNA, 18 bp, Homo sapiens
gtggtctttctgtcttct

SEQ ID NO: 10067214 - DNA, 22 bp, Homo sapiens
gtggtctttaaatttgtgcctg

SEQ ID NO: 10067215 - DNA, 22 bp, Homo sapiens
taacactgatttgttctcaggg

SEQ ID NO: 10067216 - DNA, 22 bp, Homo sapiens
taacactgccatgctggagtca

SEQ ID NO: 10067217 - DNA, 22 bp, Homo sapiens
taacactgtccaaagaattcca

SEQ ID NO: 10067218 - DNA, 22 bp, Homo sapiens
gtggcagagccgtgcaggtagg

SEQ ID NO: 10067219 - DNA, 22 bp, Homo sapiens
gtggcacagccaagcctcactc

SEQ ID NO: 10067220 - DNA, 22 bp, Homo sapiens
gtggcagagccaaggctggagc

SEQ ID NO: 10067221 - DNA, 22 bp, Homo sapiens
gtggcagggcaatgctccctct

SEQ ID NO: 10067222 - DNA, 20 bp, Homo sapiens
gtggcagtggtggcagcagt

SEQ ID NO: 10067223 - DNA, 22 bp, Homo sapiens
gtggcagtgggatgctatcagg

SEQ ID NO: 10067224 - DNA, 23 bp, Homo sapiens
gtggcctccccggaatgcctcgc

SEQ ID NO: 10067225 - DNA, 19 bp, Homo sapiens
gtggcctcggagcgcgcgg

SEQ ID NO: 10067226 - DNA, 22 bp, Homo sapiens
gtggctgagcagcagagagctg

SEQ ID NO: 10067227 - DNA, 22 bp, Homo sapiens
gtctgggctcccagggtcggcg

SEQ ID NO: 10067228 - DNA, 22 bp, Homo sapiens
gtctgggcttagggacatggca

SEQ ID NO: 10067229 - DNA, 22 bp, Homo sapiens
gtctgagcgctggagcttgtgt

SEQ ID NO: 10067230 - DNA, 22 bp, Homo sapiens
gtccttccacatggccaacttc

SEQ ID NO: 10067231 - DNA, 22 bp, Homo sapiens
gtccttccccagccagctctgg

SEQ ID NO: 10067232 - DNA, 22 bp, Homo sapiens
gtccttcctgcagggatggatg

SEQ ID NO: 10067233 - DNA, 22 bp, Homo sapiens
gtcccagggaggttcagggctt

SEQ ID NO: 10067234 - DNA, 22 bp, Homo sapiens
gtcccaggtgggctccacctct

SEQ ID NO: 10067235 - DNA, 22 bp, Homo sapiens
gtcccaggtgcccagtgggcag

SEQ ID NO: 10067236 - DNA, 22 bp, Homo sapiens
gtcccaggtcccagcacatctg

SEQ ID NO: 10067237 - DNA, 22 bp, Homo sapiens
gtcccagggccaccatatatag

SEQ ID NO: 10067238 - DNA, 22 bp, Homo sapiens
gtcccagggcaaggctgtttct

SEQ ID NO: 10067239 - DNA, 22 bp, Homo sapiens
gtcccagggatgcagacatgag

SEQ ID NO: 10067240 - DNA, 22 bp, Homo sapiens
gtccagggccccgagcaccagg

SEQ ID NO: 10067241 - DNA, 22 bp, Homo sapiens
gtacagaggtgatatttgagct

SEQ ID NO: 10067242 - DNA, 22 bp, Homo sapiens
gtacagagaaggttacatatga

SEQ ID NO: 10067243 - DNA, 22 bp, Homo sapiens
ggtgcaaaagtaatcacagttt

SEQ ID NO: 10067244 - DNA, 22 bp, Homo sapiens
ggtgcaaaaatctatcaccagc

SEQ ID NO: 10067245 - DNA, 22 bp, Homo sapiens
ggtgtagataatgatgctctcc

SEQ ID NO: 10067246 - DNA, 22 bp, Homo sapiens
gcctgcctgctgtgtgcaagtt

SEQ ID NO: 10067247 - DNA, 22 bp, Homo sapiens
gcctgccttcggtgcgcagcgg

SEQ ID NO: 10067248 - DNA, 22 bp, Homo sapiens
gcctgcctcaaaatcccagttc

SEQ ID NO: 10067249 - DNA, 22 bp, Homo sapiens
gcctgcctttgtgaggaagcgg

SEQ ID NO: 10067250 - DNA, 22 bp, Homo sapiens
gcctgccttttggaggcacatt

SEQ ID NO: 10067251 - DNA, 22 bp, Homo sapiens
gcctgtggggctgaggctgcct

SEQ ID NO: 10067252 - DNA, 22 bp, Homo sapiens
gcctgtggccactgcgtctgca

SEQ ID NO: 10067253 - DNA, 22 bp, Homo sapiens
gcccaggaggtcaagtagctat

SEQ ID NO: 10067254 - DNA, 22 bp, Homo sapiens
gcccaggatggctggaggtgct

SEQ ID NO: 10067255 - DNA, 22 bp, Homo sapiens
gcccaggatctgctcagatcat

SEQ ID NO: 10067256 - DNA, 22 bp, Homo sapiens
gccgtggccagagcccagtctc

SEQ ID NO: 10067257 - DNA, 22 bp, Homo sapiens
gccctcctttgcttctcctagt

SEQ ID NO: 10067258 - DNA, 22 bp, Homo sapiens
gctcctctgtcaaatgagagtg

SEQ ID NO: 10067259 - DNA, 22 bp, Homo sapiens
gctcctcttatttcatcagggc

SEQ ID NO: 10067260 - DNA, 22 bp, Homo sapiens
gctccaagatcattttcccatt

SEQ ID NO: 10067261 - DNA, 22 bp, Homo sapiens
gctccaggagagggaagcagat

SEQ ID NO: 10067262 - DNA, 22 bp, Homo sapiens
gctcagagatgtctgctgcctt

SEQ ID NO: 10067263 - DNA, 22 bp, Homo sapiens
gctcagagataaaactgatcag

SEQ ID NO: 10067264 - DNA, 22 bp, Homo sapiens
gctcagaaatggcagatggaga

SEQ ID NO: 10067265 - DNA, 22 bp, Homo sapiens
gctcagagcccgaggcttgcat

SEQ ID NO: 10067266 - DNA, 22 bp, Homo sapiens
gctgagcagcctaagcaaattt

SEQ ID NO: 10067267 - DNA, 22 bp, Homo sapiens
gctgagcacagcaaagagacaa

SEQ ID NO: 10067268 - DNA, 22 bp, Homo sapiens
gctgagcagggtggggaaaggc

SEQ ID NO: 10067269 - DNA, 22 bp, Homo sapiens
gctgagcacacctagggtagag

SEQ ID NO: 10067270 - DNA, 22 bp, Homo sapiens
gctgagcaacgtggagagtttt

SEQ ID NO: 10067271 - DNA, 22 bp, Homo sapiens
gctgagcaggtgtaaggaaggc

SEQ ID NO: 10067272 - DNA, 22 bp, Homo sapiens
gctgcctggagctcagcctgcc

SEQ ID NO: 10067273 - DNA, 22 bp, Homo sapiens
gctgctctcagagctcatgctg

SEQ ID NO: 10067274 - DNA, 22 bp, Homo sapiens
gctgggagttactgtctccttt

SEQ ID NO: 10067275 - DNA, 22 bp, Homo sapiens
gctgggcaacggaagagagaaa

SEQ ID NO: 10067276 - DNA, 22 bp, Homo sapiens
gctgggcaatgccagagaggag

SEQ ID NO: 10067277 - DNA, 22 bp, Homo sapiens
gctgggcaggcctcgtgagggc

SEQ ID NO: 10067278 - DNA, 22 bp, Homo sapiens
gctggagatagtaggatccata

SEQ ID NO: 10067279 - DNA, 22 bp, Homo sapiens
gctggagagtagtaagcagtta

SEQ ID NO: 10067280 - DNA, 22 bp, Homo sapiens
gatgtgtccccagaggattgaa

SEQ ID NO: 10067281 - DNA, 22 bp, Homo sapiens
gatgtgtctattcaacatgaaa

SEQ ID NO: 10067282 - DNA, 22 bp, Homo sapiens
gatgctgggaccacagagtgtt

SEQ ID NO: 10067283 - DNA, 22 bp, Homo sapiens
gatgggctgtctgagcgctgtg

SEQ ID NO: 10067284 - DNA, 22 bp, Homo sapiens
gattcacagaacttagtcaagc

SEQ ID NO: 10067285 - DNA, 22 bp, Homo sapiens
gattagaatatgtcagtcataa

SEQ ID NO: 10067286 - DNA, 22 bp, Homo sapiens
gcagagccccattgctggcggg

SEQ ID NO: 10067287 - DNA, 22 bp, Homo sapiens
gcagagccaggctggggcaggt

SEQ ID NO: 10067288 - DNA, 22 bp, Homo sapiens
gcagagcatgtcctcaggacag

SEQ ID NO: 10067289 - DNA, 18 bp, Homo sapiens
gcagagcatcaagggtta

SEQ ID NO: 10067290 - DNA, 22 bp, Homo sapiens
gcagaacaacgtaggagtggag

SEQ ID NO: 10067291 - DNA, 22 bp, Homo sapiens
gcagaacatggaaagagaacta

SEQ ID NO: 10067292 - DNA, 22 bp, Homo sapiens
gcagaagcccggtcagcgcacg

SEQ ID NO: 10067293 - DNA, 22 bp, Homo sapiens
gcacctccaggggccgcccacc

SEQ ID NO: 10067294 - DNA, 22 bp, Homo sapiens
gattttcatttgcactctagaa

SEQ ID NO: 10067295 - DNA, 22 bp, Homo sapiens
gatttgtggtgtgaggaagagc

SEQ ID NO: 10067296 - DNA, 22 bp, Homo sapiens
gcatgtgggagggtcttcccac

SEQ ID NO: 10067297 - DNA, 22 bp, Homo sapiens
gccacacttattctcatgcaca

SEQ ID NO: 10067298 - DNA, 22 bp, Homo sapiens
gccagcaccagctactagtcac

SEQ ID NO: 10067299 - DNA, 22 bp, Homo sapiens
gcaggtggggctgctaccagaa

SEQ ID NO: 10067300 - DNA, 22 bp, Homo sapiens
gcaggtggtcactcatccccag

SEQ ID NO: 10067301 - DNA, 22 bp, Homo sapiens
gcaggtggttaaggtcccatgt

SEQ ID NO: 10067302 - DNA, 22 bp, Homo sapiens
gcagtgggagcttaggcagtgc

SEQ ID NO: 10067303 - DNA, 22 bp, Homo sapiens
gcaggagccagggattccagga

SEQ ID NO: 10067304 - DNA, 22 bp, Homo sapiens
gcagagccctgggggtatggtg

SEQ ID NO: 10067305 - DNA, 22 bp, Homo sapiens
gcagggcacagacagtgccaag

SEQ ID NO: 10067306 - DNA, 22 bp, Homo sapiens
gcagggcagaaggtgctgagga

SEQ ID NO: 10067307 - DNA, 22 bp, Homo sapiens
gcagggcagagggagaatctct

SEQ ID NO: 10067308 - DNA, 22 bp, Homo sapiens
gcagggcagacctccagcctat

SEQ ID NO: 10067309 - DNA, 22 bp, Homo sapiens
gcagggcacacaagaatgataa

SEQ ID NO: 10067310 - DNA, 22 bp, Homo sapiens
gcagggcaatgatcccgagagg

SEQ ID NO: 10067311 - DNA, 22 bp, Homo sapiens
gcagggcacaaggacgcacagg

SEQ ID NO: 10067312 - DNA, 20 bp, Homo sapiens
gcagggcaagggatatgaaa

SEQ ID NO: 10067313 - DNA, 22 bp, Homo sapiens
gcagggcaaatgtggaaaggag

SEQ ID NO: 10067314 - DNA, 22 bp, Homo sapiens
gcagggcagccacaggccccct

SEQ ID NO: 10067315 - DNA, 22 bp, Homo sapiens
gcagggggtcattcacgctggc

SEQ ID NO: 10067316 - DNA, 22 bp, Homo sapiens
gaggcctcttctttgttaacct

SEQ ID NO: 10067317 - DNA, 22 bp, Homo sapiens
gaggcctcatgaggtgagcatt

SEQ ID NO: 10067318 - DNA, 22 bp, Homo sapiens
gaggagggagctggaagctctt

SEQ ID NO: 10067319 - DNA, 22 bp, Homo sapiens
gaggaggcttccgggaggcacg

SEQ ID NO: 10067320 - DNA, 22 bp, Homo sapiens
gaggaggctgtttctctgcatt

SEQ ID NO: 10067321 - DNA, 22 bp, Homo sapiens
gaggaggctggcgccgcctgcc

SEQ ID NO: 10067322 - DNA, 22 bp, Homo sapiens
gaggaggctgaacaatgccctg

SEQ ID NO: 10067323 - DNA, 22 bp, Homo sapiens
gagctgggaggactgggaactt

SEQ ID NO: 10067324 - DNA, 18 bp, Homo sapiens
gagctgggagaaggaagg

SEQ ID NO: 10067325 - DNA, 22 bp, Homo sapiens
gaggacagagccgcctggcaag

SEQ ID NO: 10067326 - DNA, 22 bp, Homo sapiens
gaggaggctatcagcaatcagg

SEQ ID NO: 10067327 - DNA, 22 bp, Homo sapiens
gagctgggacatgggtcctctc

SEQ ID NO: 10067328 - DNA, 22 bp, Homo sapiens
gaggctgggaagtccaagacca

SEQ ID NO: 10067329 - DNA, 22 bp, Homo sapiens
gaggggaaagtgtgaggctgcg

SEQ ID NO: 10067330 - DNA, 22 bp, Homo sapiens
gagtccagagattaagcacctc

SEQ ID NO: 10067331 - DNA, 22 bp, Homo sapiens
gaggtcctctcggaaccccttt

SEQ ID NO: 10067332 - DNA, 22 bp, Homo sapiens
gatccccaggactagggggtgg

SEQ ID NO: 10067333 - DNA, 22 bp, Homo sapiens
gatccctgccctcagcctggac

SEQ ID NO: 10067334 - DNA, 22 bp, Homo sapiens
gatgatggtactgtatttgaat

SEQ ID NO: 10067335 - DNA, 22 bp, Homo sapiens
gatgatgggcgctgtttactgg

SEQ ID NO: 10067336 - DNA, 22 bp, Homo sapiens
gatgatgggatccagcaatgta

SEQ ID NO: 10067337 - DNA, 22 bp, Homo sapiens
gatcagaatcttcattttcagt

SEQ ID NO: 10067338 - DNA, 22 bp, Homo sapiens
gatcagaatttacttataattg

SEQ ID NO: 10067339 - DNA, 22 bp, Homo sapiens
gatcagaatgggacatatcctg

SEQ ID NO: 10067340 - DNA, 22 bp, Homo sapiens
gatcagaattcttgtgtgtttc

SEQ ID NO: 10067341 - DNA, 22 bp, Homo sapiens
gatcaggagatggcctcagacc

SEQ ID NO: 10067342 - DNA, 22 bp, Homo sapiens
gagtttaacacttggagaaaag

SEQ ID NO: 10067343 - DNA, 22 bp, Homo sapiens
gagtgctgctaatgcaagggtg

SEQ ID NO: 10067344 - DNA, 22 bp, Homo sapiens
gagtgctgcttgggatagtgag

SEQ ID NO: 10067345 - DNA, 21 bp, Homo sapiens
gagtgggacatgggagtggtt

SEQ ID NO: 10067346 - DNA, 22 bp, Homo sapiens
gagtgggaatgttctaagaatt

SEQ ID NO: 10067347 - DNA, 22 bp, Homo sapiens
gagtgctgtatctgagaaagca

SEQ ID NO: 10067348 - DNA, 22 bp, Homo sapiens
cttctttgttctgttgtctcac

SEQ ID NO: 10067349 - DNA, 22 bp, Homo sapiens
cttctctgcaccccacttttgc

SEQ ID NO: 10067350 - DNA, 22 bp, Homo sapiens
cttgggagtagaggcaggagca

SEQ ID NO: 10067351 - DNA, 22 bp, Homo sapiens
cttgggcacatccctggtattt

SEQ ID NO: 10067352 - DNA, 22 bp, Homo sapiens
cttgggctcagcaccgtgtgga

SEQ ID NO: 10067353 - DNA, 22 bp, Homo sapiens
cttggggctttgtgtgtaggat

SEQ ID NO: 10067354 - DNA, 22 bp, Homo sapiens
cttggggcagcccaggctgagc

SEQ ID NO: 10067355 - DNA, 22 bp, Homo sapiens
cttggctgtcataaggtcctgg

SEQ ID NO: 10067356 - DNA, 22 bp, Homo sapiens
cttggctgggaactgtgattca

SEQ ID NO: 10067357 - DNA, 20 bp, Homo sapiens
gaacggcaatggagctggca

SEQ ID NO: 10067358 - DNA, 22 bp, Homo sapiens
gaacagagctgactacaaggca

SEQ ID NO: 10067359 - DNA, 22 bp, Homo sapiens
gaacagagttgaaacaaggctg

SEQ ID NO: 10067360 - DNA, 22 bp, Homo sapiens
gaacagacttggaggagtgatc

SEQ ID NO: 10067361 - DNA, 21 bp, Homo sapiens
gaacccagcagcagtgctctg

SEQ ID NO: 10067362 - DNA, 23 bp, Homo sapiens
gaacagacattagtgagccaggc

SEQ ID NO: 10067363 - DNA, 22 bp, Homo sapiens
gaacacagtcaagggctgctgt

SEQ ID NO: 10067364 - DNA, 22 bp, Homo sapiens
gaacacaggtggcccggcaggg

SEQ ID NO: 10067365 - DNA, 22 bp, Homo sapiens
gaaaaggcctccccataggaat

SEQ ID NO: 10067366 - DNA, 22 bp, Homo sapiens
gaaaagagtcctgtgtgaggag

SEQ ID NO: 10067367 - DNA, 22 bp, Homo sapiens
gaaaagagacagggtgggtgat

SEQ ID NO: 10067368 - DNA, 22 bp, Homo sapiens
gaaaggcaggcagggtgtccat

SEQ ID NO: 10067369 - DNA, 22 bp, Homo sapiens
gaaaggcagtacagctgagcct

SEQ ID NO: 10067370 - DNA, 19 bp, Homo sapiens
gaaaggctgctgctacctg

SEQ ID NO: 10067371 - DNA, 22 bp, Homo sapiens
gaaagggataccatgttacttg

SEQ ID NO: 10067372 - DNA, 22 bp, Homo sapiens
gacacagggacgtgctctgcct

SEQ ID NO: 10067373 - DNA, 22 bp, Homo sapiens
gacacaggattcctggctctgc

SEQ ID NO: 10067374 - DNA, 22 bp, Homo sapiens
gacacaggattcctggctctgc

SEQ ID NO: 10067375 - DNA, 22 bp, Homo sapiens
gacacagagataggcctgtgtt

SEQ ID NO: 10067376 - DNA, 22 bp, Homo sapiens
gaattgactgcgtttgcttcct

SEQ ID NO: 10067377 - DNA, 22 bp, Homo sapiens
gaagtgcaaaaccacatggtaa

SEQ ID NO: 10067378 - DNA, 22 bp, Homo sapiens
gagagctgcagccgagaggggg

SEQ ID NO: 10067379 - DNA, 22 bp, Homo sapiens
gactggggtaaggtgaggaggt

SEQ ID NO: 10067380 - DNA, 22 bp, Homo sapiens
gactgtggcgtagatgctggga

SEQ ID NO: 10067381 - DNA, 22 bp, Homo sapiens
gacttcttcatgtcttttccac

SEQ ID NO: 10067382 - DNA, 22 bp, Homo sapiens
gacttgggctgagggccagcag

SEQ ID NO: 10067383 - DNA, 22 bp, Homo sapiens
gacttgggcttgggcgtgggtt

SEQ ID NO: 10067384 - DNA, 22 bp, Homo sapiens
gacttgggtggattgtgactct

SEQ ID NO: 10067385 - DNA, 22 bp, Homo sapiens
gacttgggggaagatgtggctg

SEQ ID NO: 10067386 - DNA, 22 bp, Homo sapiens
gacttggggatttatctcacag

SEQ ID NO: 10067387 - DNA, 22 bp, Homo sapiens
gacttgggtgtcggggcagtct

SEQ ID NO: 10067388 - DNA, 22 bp, Homo sapiens
cctctctgtgtggcctctccat

SEQ ID NO: 10067389 - DNA, 22 bp, Homo sapiens
cctctcctggctgtaggacctc

SEQ ID NO: 10067390 - DNA, 22 bp, Homo sapiens
cctctgagaggccatctctcct

SEQ ID NO: 10067391 - DNA, 22 bp, Homo sapiens
cctccctggccagagcagcagc

SEQ ID NO: 10067392 - DNA, 22 bp, Homo sapiens
cctcctctgggaagattcagag

SEQ ID NO: 10067393 - DNA, 22 bp, Homo sapiens
cctcctagaggaaccccagggc

SEQ ID NO: 10067394 - DNA, 22 bp, Homo sapiens
tggctcagtttctgcccagctg

SEQ ID NO: 10067395 - DNA, 22 bp, Homo sapiens
tggctcagtttcagtcctggtt

SEQ ID NO: 10067396 - DNA, 22 bp, Homo sapiens
tggctcagtttgggggattgaa

SEQ ID NO: 10067397 - DNA, 22 bp, Homo sapiens
tggctcagctgtcacagcctgg

SEQ ID NO: 10067398 - DNA, 22 bp, Homo sapiens
tggctcagtttagcagctcagt

SEQ ID NO: 10067399 - DNA, 22 bp, Homo sapiens
tggcccctgaggagcatcagcc

SEQ ID NO: 10067400 - DNA, 22 bp, Homo sapiens
tggcccctgaggagcgtcagcc

SEQ ID NO: 10067401 - DNA, 20 bp, Homo sapiens
tggcccagtggggcagggtg

SEQ ID NO: 10067402 - DNA, 22 bp, Homo sapiens
tggcagcaattagctagagctg

SEQ ID NO: 10067403 - DNA, 21 bp, Homo sapiens
tgccaggcctgagctggggtc

SEQ ID NO: 10067404 - DNA, 22 bp, Homo sapiens
cccaggcagtgctgatccctca

SEQ ID NO: 10067405 - DNA, 22 bp, Homo sapiens
tgcctgctctgtgccacagttg

SEQ ID NO: 10067406 - DNA, 20 bp, Homo sapiens
cccaggcagagctagcggca

SEQ ID NO: 10067407 - DNA, 22 bp, Homo sapiens
cccaggcagcggggtctccttg

SEQ ID NO: 10067408 - DNA, 22 bp, Homo sapiens
cccaggaaaagcagtgccagca

SEQ ID NO: 10067409 - DNA, 22 bp, Homo sapiens
cccaggaaagaaagtatatggt

SEQ ID NO: 10067410 - DNA, 22 bp, Homo sapiens
cccaggctgagttagaggtgtc

SEQ ID NO: 10067411 - DNA, 22 bp, Homo sapiens
tgcctgggcctctgaggaaggc

SEQ ID NO: 10067412 - DNA, 22 bp, Homo sapiens
cccagggaggcccaggctctgc

SEQ ID NO: 10067413 - DNA, 22 bp, Homo sapiens
cccagggagagcgcggaggcgg

SEQ ID NO: 10067414 - DNA, 20 bp, Homo sapiens
cccagggacctgagctccat

SEQ ID NO: 10067415 - DNA, 22 bp, Homo sapiens
cccagggaggtagcaggagaaa

SEQ ID NO: 10067416 - DNA, 22 bp, Homo sapiens
tgctgaatgggatatgttgagc

SEQ ID NO: 10067417 - DNA, 22 bp, Homo sapiens
ccctaggaattctatggccaag

SEQ ID NO: 10067418 - DNA, 22 bp, Homo sapiens
cccctccctgacctggttgggc

SEQ ID NO: 10067419 - DNA, 19 bp, Homo sapiens
tgtggggagtcagggggct

SEQ ID NO: 10067420 - DNA, 22 bp, Homo sapiens
tgtggcaggcaagatgtacaga

SEQ ID NO: 10067421 - DNA, 22 bp, Homo sapiens
tgtggcaggatgcggaagatgc

SEQ ID NO: 10067422 - DNA, 22 bp, Homo sapiens
tgtggcagctggaggtggagaa

SEQ ID NO: 10067423 - DNA, 22 bp, Homo sapiens
tgtgcttgtcgtggagccaggc

SEQ ID NO: 10067424 - DNA, 22 bp, Homo sapiens
tgtgctttggttttacaggatg

SEQ ID NO: 10067425 - DNA, 22 bp, Homo sapiens
cctgggctttgctggcaaggcc

SEQ ID NO: 10067426 - DNA, 22 bp, Homo sapiens
cctgggtcctggcagcctcctg

SEQ ID NO: 10067427 - DNA, 22 bp, Homo sapiens
tgtctgtaatagtcactatgtg

SEQ ID NO: 10067428 - DNA, 22 bp, Homo sapiens
tgtctgtattgaggtgcatatt

SEQ ID NO: 10067429 - DNA, 22 bp, Homo sapiens
tgtgagcagagcctgacatgag

SEQ ID NO: 10067430 - DNA, 17 bp, Homo sapiens
tgtgagcatctatagaa

SEQ ID NO: 10067431 - DNA, 22 bp, Homo sapiens
tgtgaggaacaggactagagca

SEQ ID NO: 10067432 - DNA, 23 bp, Homo sapiens
tggtcttgaactcctgtccctgc

SEQ ID NO: 10067433 - DNA, 21 bp, Homo sapiens
cctggactgggagcagcactg

SEQ ID NO: 10067434 - DNA, 22 bp, Homo sapiens
tggtgctgataatggcaggatt

SEQ ID NO: 10067435 - DNA, 22 bp, Homo sapiens
ctggcccagagctctggccttt

SEQ ID NO: 10067436 - DNA, 21 bp, Homo sapiens
ctggcccagggatctgcattt

SEQ ID NO: 10067437 - DNA, 22 bp, Homo sapiens
ctggctccactccctgcctgac

SEQ ID NO: 10067438 - DNA, 22 bp, Homo sapiens
ctggataagagttttacttcct

SEQ ID NO: 10067439 - DNA, 22 bp, Homo sapiens
ctggataatcacagaggagcat

SEQ ID NO: 10067440 - DNA, 22 bp, Homo sapiens
ctggataaatgtttgctttaga

SEQ ID NO: 10067441 - DNA, 22 bp, Homo sapiens
ctggataaatgctttagttgga

SEQ ID NO: 10067442 - DNA, 22 bp, Homo sapiens
ctggcacatgtgagccacatca

SEQ ID NO: 10067443 - DNA, 22 bp, Homo sapiens
ctggcacatagtcagcactcaa

SEQ ID NO: 10067444 - DNA, 22 bp, Homo sapiens
ctgcctgctcaccagggctctg

SEQ ID NO: 10067445 - DNA, 19 bp, Homo sapiens
ctggacacactctattgct

SEQ ID NO: 10067446 - DNA, 22 bp, Homo sapiens
ctgcctcctcacgtccacagtg

SEQ ID NO: 10067447 - DNA, 22 bp, Homo sapiens
ctgcctcatgctgcctgcagcc

SEQ ID NO: 10067448 - DNA, 22 bp, Homo sapiens
ctgccagctctctggaggctct

SEQ ID NO: 10067449 - DNA, 22 bp, Homo sapiens
ctgcagagcttgtctggatgtg

SEQ ID NO: 10067450 - DNA, 22 bp, Homo sapiens
ctctggctgtttgcagctcaag

SEQ ID NO: 10067451 - DNA, 22 bp, Homo sapiens
ctctcctctgaagtggtgaccc

SEQ ID NO: 10067452 - DNA, 22 bp, Homo sapiens
ctctcctgggctgaccgtccga

SEQ ID NO: 10067453 - DNA, 21 bp, Homo sapiens
cggctcagtgcctgctccttc

SEQ ID NO: 10067454 - DNA, 22 bp, Homo sapiens
ttcagaaaaagaccattgcaat

SEQ ID NO: 10067455 - DNA, 22 bp, Homo sapiens
ttcagaaacccattgggtctct

SEQ ID NO: 10067456 - DNA, 22 bp, Homo sapiens
ttcagaaaggtaaatggatttc

SEQ ID NO: 10067457 - DNA, 22 bp, Homo sapiens
ttcagaaaggataattggaagg

SEQ ID NO: 10067458 - DNA, 22 bp, Homo sapiens
ttcagaaaggctgtgccagcca

SEQ ID NO: 10067459 - DNA, 22 bp, Homo sapiens
cggctcaggccacaggacggca

SEQ ID NO: 10067460 - DNA, 22 bp, Homo sapiens
cgctggtgaaggctaggctagc

SEQ ID NO: 10067461 - DNA, 22 bp, Homo sapiens
ttccttcctggggatttatcat

SEQ ID NO: 10067462 - DNA, 22 bp, Homo sapiens
ttccttcctgtcttccttactg

SEQ ID NO: 10067463 - DNA, 22 bp, Homo sapiens
ttccttcctctttcacaacagc

SEQ ID NO: 10067464 - DNA, 22 bp, Homo sapiens
ttccttcctcctccagttctgg

SEQ ID NO: 10067465 - DNA, 22 bp, Homo sapiens
ttccttccatagcaaaacatgc

SEQ ID NO: 10067466 - DNA, 22 bp, Homo sapiens
ttccttccagcttgtgacagtc

SEQ ID NO: 10067467 - DNA, 22 bp, Homo sapiens
ttccttccgggcaccaggcact

SEQ ID NO: 10067468 - DNA, 22 bp, Homo sapiens
ttccttccctcagtggctgaag

SEQ ID NO: 10067469 - DNA, 22 bp, Homo sapiens
ttccttcccctagctgagaaac

SEQ ID NO: 10067470 - DNA, 22 bp, Homo sapiens
ttccttccacttcaggattttg

SEQ ID NO: 10067471 - DNA, 22 bp, Homo sapiens
ttccaggcacatcccaactcca

SEQ ID NO: 10067472 - DNA, 22 bp, Homo sapiens
ttccaggcaaaggaagcagctt

SEQ ID NO: 10067473 - DNA, 22 bp, Homo sapiens
ttcttggcaatggtattcatcc

SEQ ID NO: 10067474 - DNA, 22 bp, Homo sapiens
ttcttggcattttcccatttgg

SEQ ID NO: 10067475 - DNA, 22 bp, Homo sapiens
ctccagggggcatccacacagc

SEQ ID NO: 10067476 - DNA, 22 bp, Homo sapiens
ctccaggcgcttaccaagcgct

SEQ ID NO: 10067477 - DNA, 22 bp, Homo sapiens
ctccaggcccctggccttctgc

SEQ ID NO: 10067478 - DNA, 22 bp, Homo sapiens
ctccaggcgccgcttttgcagt

SEQ ID NO: 10067479 - DNA, 22 bp, Homo sapiens
ctccagtcttctcatgtatccc

SEQ ID NO: 10067480 - DNA, 22 bp, Homo sapiens
ttggaaaaattgcctgatgtct

SEQ ID NO: 10067481 - DNA, 22 bp, Homo sapiens
ctcctctgtctggccctgagcc

SEQ ID NO: 10067482 - DNA, 22 bp, Homo sapiens
ctcctctgtattgattgggact

SEQ ID NO: 10067483 - DNA, 22 bp, Homo sapiens
ctcctctgtctaccacgagggt

SEQ ID NO: 10067484 - DNA, 22 bp, Homo sapiens
ctcctctgggtcctggtggcca

SEQ ID NO: 10067485 - DNA, 22 bp, Homo sapiens
ctcctctggaaattcctctgcc

SEQ ID NO: 10067486 - DNA, 22 bp, Homo sapiens
ctcctctggcttcctggaggca

SEQ ID NO: 10067487 - DNA, 17 bp, Homo sapiens
ctcctctctgggttact

SEQ ID NO: 10067488 - DNA, 22 bp, Homo sapiens
ctctccctaggttagcggtcag

SEQ ID NO: 10067489 - DNA, 22 bp, Homo sapiens
ctctccctatgcctcccaggag

SEQ ID NO: 10067490 - DNA, 22 bp, Homo sapiens
ctctcctacatttcattcacaa

SEQ ID NO: 10067491 - DNA, 20 bp, Homo sapiens
ctctcctcacccgtgtcagg

SEQ ID NO: 10067492 - DNA, 22 bp, Homo sapiens
ctctccctggccagctgtgcag

SEQ ID NO: 10067493 - DNA, 22 bp, Homo sapiens
ctctcctccaggaactcacagt

SEQ ID NO: 10067494 - DNA, 22 bp, Homo sapiens
ctctcctccaacagccctgccg

SEQ ID NO: 10067495 - DNA, 22 bp, Homo sapiens
ctcctgggctgtcggcgctctg

SEQ ID NO: 10067496 - DNA, 22 bp, Homo sapiens
ctcctgggagtcttcctggatg

SEQ ID NO: 10067497 - DNA, 22 bp, Homo sapiens
ctcctgggagcagggatggatg

SEQ ID NO: 10067498 - DNA, 22 bp, Homo sapiens
ctcctgggatgactctttcttt

SEQ ID NO: 10067499 - DNA, 22 bp, Homo sapiens
ctcctgggctatgtctgcttgg

SEQ ID NO: 10067500 - DNA, 22 bp, Homo sapiens
ctcctgggctcatatcattcag

SEQ ID NO: 10067501 - DNA, 20 bp, Homo sapiens
gttaaaagagtaatttgagg

SEQ ID NO: 10067502 - DNA, 21 bp, Homo sapiens
caggaaagaaaacgtacatat

SEQ ID NO: 10067503 - DNA, 22 bp, Homo sapiens
caggaaaggtgtgtcatgatgg

SEQ ID NO: 10067504 - DNA, 22 bp, Homo sapiens
caggaaaggtagtcacaatgta

SEQ ID NO: 10067505 - DNA, 22 bp, Homo sapiens
cagctggccccacagtagaggc

SEQ ID NO: 10067506 - DNA, 22 bp, Homo sapiens
cagctggctgcggtgaggggac

SEQ ID NO: 10067507 - DNA, 22 bp, Homo sapiens
cagctgggagctccattagata

SEQ ID NO: 10067508 - DNA, 22 bp, Homo sapiens
cagctggggcagccacgtgcgg

SEQ ID NO: 10067509 - DNA, 22 bp, Homo sapiens
cagctggggagagacatggcag

SEQ ID NO: 10067510 - DNA, 22 bp, Homo sapiens
cagctggggagagacatggcag

SEQ ID NO: 10067511 - DNA, 22 bp, Homo sapiens
cagctgtgagagtgcattgaag

SEQ ID NO: 10067512 - DNA, 22 bp, Homo sapiens
gtggcagtgaggcaggagcagt

SEQ ID NO: 10067513 - DNA, 22 bp, Homo sapiens
gtggcagtcggaagtcaggaga

SEQ ID NO: 10067514 - DNA, 22 bp, Homo sapiens
gtggcagtcatcaaggacagat

SEQ ID NO: 10067515 - DNA, 22 bp, Homo sapiens
cagcccagccgagggcctggct

SEQ ID NO: 10067516 - DNA, 22 bp, Homo sapiens
cagcccagccttgtctctttat

SEQ ID NO: 10067517 - DNA, 22 bp, Homo sapiens
cagcccagcgcaaacaactggc

SEQ ID NO: 10067518 - DNA, 22 bp, Homo sapiens
cagcccaggactgcaggtgttt

SEQ ID NO: 10067519 - DNA, 21 bp, Homo sapiens
cagcccagcttcttccccagt

SEQ ID NO: 10067520 - DNA, 22 bp, Homo sapiens
cagcccagctgggatcacactc

SEQ ID NO: 10067521 - DNA, 22 bp, Homo sapiens
cagcccagctctgactaaccct

SEQ ID NO: 10067522 - DNA, 22 bp, Homo sapiens
cagcccaggccgacagttcctc

SEQ ID NO: 10067523 - DNA, 22 bp, Homo sapiens
gtggcagagcaggagacaggac

SEQ ID NO: 10067524 - DNA, 22 bp, Homo sapiens
gtgggcaggccccaaagcaggg

SEQ ID NO: 10067525 - DNA, 22 bp, Homo sapiens
gtgggcaggagtgagcaacagg

SEQ ID NO: 10067526 - DNA, 22 bp, Homo sapiens
gtgggcaggccctaggcgattt

SEQ ID NO: 10067527 - DNA, 22 bp, Homo sapiens
cagctgagctcccaggccatca

SEQ ID NO: 10067528 - DNA, 22 bp, Homo sapiens
cagctgaggtcaaagaagcagg

SEQ ID NO: 10067529 - DNA, 22 bp, Homo sapiens
caggagcctcctgattccaatt

SEQ ID NO: 10067530 - DNA, 22 bp, Homo sapiens
caggagcccgttgctccggcgg

SEQ ID NO: 10067531 - DNA, 22 bp, Homo sapiens
caggagagatatgagtccccac

SEQ ID NO: 10067532 - DNA, 22 bp, Homo sapiens
caggaggcccacaggcccctgc

SEQ ID NO: 10067533 - DNA, 22 bp, Homo sapiens
caggaggcccaaagggcgcaga

SEQ ID NO: 10067534 - DNA, 22 bp, Homo sapiens
caggaggccaactgtgggactt

SEQ ID NO: 10067535 - DNA, 22 bp, Homo sapiens
caggagggtgtggaaaactggg

SEQ ID NO: 10067536 - DNA, 22 bp, Homo sapiens
caggaggcccggccacagccca

SEQ ID NO: 10067537 - DNA, 22 bp, Homo sapiens
caggagtgtcgggtcactaggt

SEQ ID NO: 10067538 - DNA, 22 bp, Homo sapiens
caggaggcagaggttgcagcga

SEQ ID NO: 10067539 - DNA, 22 bp, Homo sapiens
caggagctgggtctggaagcag

SEQ ID NO: 10067540 - DNA, 22 bp, Homo sapiens
caggaagggggatccttggaag

SEQ ID NO: 10067541 - DNA, 22 bp, Homo sapiens
caggacagttggcatctgctgc

SEQ ID NO: 10067542 - DNA, 22 bp, Homo sapiens
tacaggggtaacagtggggaat

SEQ ID NO: 10067543 - DNA, 22 bp, Homo sapiens
caggcagctgctgggttcagcc

SEQ ID NO: 10067544 - DNA, 22 bp, Homo sapiens
caggcagctgactgtcagatat

SEQ ID NO: 10067545 - DNA, 22 bp, Homo sapiens
caggatccctggcctccgccca

SEQ ID NO: 10067546 - DNA, 22 bp, Homo sapiens
caggatccccaggtcgccgtcc

SEQ ID NO: 10067547 - DNA, 22 bp, Homo sapiens
tcagggcattcaagaggcctgg

SEQ ID NO: 10067548 - DNA, 22 bp, Homo sapiens
tcagggcatgtatgtttcttta

SEQ ID NO: 10067549 - DNA, 22 bp, Homo sapiens
tcagggcatggctgcacttggc

SEQ ID NO: 10067550 - DNA, 20 bp, Homo sapiens
tcagggcatgggacagcccc

SEQ ID NO: 10067551 - DNA, 22 bp, Homo sapiens
catccaggcaccacaaccagct

SEQ ID NO: 10067552 - DNA, 22 bp, Homo sapiens
tcaggaagtgcctaggctggcc

SEQ ID NO: 10067553 - DNA, 22 bp, Homo sapiens
catgggaataggttgttcttgg

SEQ ID NO: 10067554 - DNA, 22 bp, Homo sapiens
catgggaataaagttatttcaa

SEQ ID NO: 10067555 - DNA, 22 bp, Homo sapiens
catgcacaagggatgatgaaat

SEQ ID NO: 10067556 - DNA, 22 bp, Homo sapiens
catgcacaacatactcaagagg

SEQ ID NO: 10067557 - DNA, 22 bp, Homo sapiens
catgatcaccacttgacagccc

SEQ ID NO: 10067558 - DNA, 22 bp, Homo sapiens
catgatggatgtgcacttcgct

SEQ ID NO: 10067559 - DNA, 22 bp, Homo sapiens
catgatggctcatgcttgtaat

SEQ ID NO: 10067560 - DNA, 22 bp, Homo sapiens
catgatggggaatgttaaggga

SEQ ID NO: 10067561 - DNA, 22 bp, Homo sapiens
tcagaaatactatcagcttttg

SEQ ID NO: 10067562 - DNA, 20 bp, Homo sapiens
cagtcctgtccctgctgccc

SEQ ID NO: 10067563 - DNA, 22 bp, Homo sapiens
cagtctccgccagctcctcaca

SEQ ID NO: 10067564 - DNA, 22 bp, Homo sapiens
cagtgagggcccccttccaggt

SEQ ID NO: 10067565 - DNA, 22 bp, Homo sapiens
cagtgaggtggatggatggcct

SEQ ID NO: 10067566 - DNA, 22 bp, Homo sapiens
caggtctccagctcagggtcca

SEQ ID NO: 10067567 - DNA, 22 bp, Homo sapiens
cagggtggcacatcacagcatt

SEQ ID NO: 10067568 - DNA, 22 bp, Homo sapiens
cagggtggcacatcacagcatt

SEQ ID NO: 10067569 - DNA, 22 bp, Homo sapiens
ccactctgatttcaagggagat

SEQ ID NO: 10067570 - DNA, 22 bp, Homo sapiens
ccacagggtgtcatcagcttga

SEQ ID NO: 10067571 - DNA, 22 bp, Homo sapiens
ccactgccagctttgtcctccc

SEQ ID NO: 10067572 - DNA, 22 bp, Homo sapiens
ccactgccgatgttccatcttg

SEQ ID NO: 10067573 - DNA, 22 bp, Homo sapiens
ccagaagcttctacacaggaga

SEQ ID NO: 10067574 - DNA, 22 bp, Homo sapiens
ccagaagcagagcctgaggcag

SEQ ID NO: 10067575 - DNA, 22 bp, Homo sapiens
ccagaagccctttgtttgttgt

SEQ ID NO: 10067576 - DNA, 22 bp, Homo sapiens
ccagaagctatgttttagataa

SEQ ID NO: 10067577 - DNA, 22 bp, Homo sapiens
ccagaagcacctccttttgtgc

SEQ ID NO: 10067578 - DNA, 22 bp, Homo sapiens
ccagaatttggatcatgatttt

SEQ ID NO: 10067579 - DNA, 22 bp, Homo sapiens
ccagaattcagaaagggcataa

SEQ ID NO: 10067580 - DNA, 22 bp, Homo sapiens
ccagaatttgaactcaggcaat

SEQ ID NO: 10067581 - DNA, 22 bp, Homo sapiens
ccagatgggaagaagcatgact

SEQ ID NO: 10067582 - DNA, 22 bp, Homo sapiens
ccagatgggctttagcaaatga

SEQ ID NO: 10067583 - DNA, 20 bp, Homo sapiens
ccagatggtccctgtgaaaa

SEQ ID NO: 10067584 - DNA, 22 bp, Homo sapiens
tcccagggcagctgtccagaag

SEQ ID NO: 10067585 - DNA, 22 bp, Homo sapiens
tcccagggtcagtggtgaggcc

SEQ ID NO: 10067586 - DNA, 17 bp, Homo sapiens
tccaggcagcaactgag

SEQ ID NO: 10067587 - DNA, 20 bp, Homo sapiens
tccaggcagacagctatggg

SEQ ID NO: 10067588 - DNA, 22 bp, Homo sapiens
ccacagctgaaagcagaggctc

SEQ ID NO: 10067589 - DNA, 22 bp, Homo sapiens
ccagctcctcttgtctctagca

SEQ ID NO: 10067590 - DNA, 22 bp, Homo sapiens
tctgccaccttcatcctccact

SEQ ID NO: 10067591 - DNA, 22 bp, Homo sapiens
tctgagttttctgagaagctta

SEQ ID NO: 10067592 - DNA, 22 bp, Homo sapiens
tctgagtttttgcagctgctgt

SEQ ID NO: 10067593 - DNA, 22 bp, Homo sapiens
tctgagttacacaagcaagggt

SEQ ID NO: 10067594 - DNA, 22 bp, Homo sapiens
ccagcgactgtgacctcagcta

SEQ ID NO: 10067595 - DNA, 22 bp, Homo sapiens
ccagctccagcatagccaccat

SEQ ID NO: 10067596 - DNA, 22 bp, Homo sapiens
ccagccacgaagctcccttcat

SEQ ID NO: 10067597 - DNA, 22 bp, Homo sapiens
tctgagtcctaaacccccaggg

SEQ ID NO: 10067598 - DNA, 22 bp, Homo sapiens
ccagctggtctgtgctcatgtt

SEQ ID NO: 10067599 - DNA, 22 bp, Homo sapiens
ccagctggggaagtggggcata

SEQ ID NO: 10067600 - DNA, 22 bp, Homo sapiens
ccagctggtaagtgatggagcc

SEQ ID NO: 10067601 - DNA, 22 bp, Homo sapiens
ccagctgggtccctgctggggc

SEQ ID NO: 10067602 - DNA, 22 bp, Homo sapiens
ccaggaggcggaaggtacagtg

SEQ ID NO: 10067603 - DNA, 22 bp, Homo sapiens
ccaggaagctgtctgatatgaa

SEQ ID NO: 10067604 - DNA, 22 bp, Homo sapiens
ccaggaagacacatgctcatcc

SEQ ID NO: 10067605 - DNA, 22 bp, Homo sapiens
tctgggctgctatgaggcagag

SEQ ID NO: 10067606 - DNA, 22 bp, Homo sapiens
tctgggctgctgtgcagtgacc

SEQ ID NO: 10067607 - DNA, 23 bp, Homo sapiens
tctgggctgagacttggaaggtc

SEQ ID NO: 10067608 - DNA, 23 bp, Homo sapiens
tctgggctgagctcgagtgtaga

SEQ ID NO: 10067609 - DNA, 22 bp, Homo sapiens
tctgatcagaagtacttggttc

SEQ ID NO: 10067610 - DNA, 23 bp, Homo sapiens
tctgatgtctctggaagctcatg

SEQ ID NO: 10067611 - DNA, 22 bp, Homo sapiens
tctgatgtctgaaatgctcttg

SEQ ID NO: 10067612 - DNA, 22 bp, Homo sapiens
tctgagacttctgaagctagaa

SEQ ID NO: 10067613 - DNA, 20 bp, Homo sapiens
tctgagacctttccacaccc

SEQ ID NO: 10067614 - DNA, 22 bp, Homo sapiens
tctgagacaacttagccctcga

SEQ ID NO: 10067615 - DNA, 22 bp, Homo sapiens
tctgagccagggtctcctccct

SEQ ID NO: 10067616 - DNA, 22 bp, Homo sapiens
tctgcagcacttaatgtttcgt

SEQ ID NO: 10067617 - DNA, 22 bp, Homo sapiens
tctgcacaaaactgtcgcagaa

SEQ ID NO: 10067618 - DNA, 22 bp, Homo sapiens
tctgcacaagtaagggtttaat

SEQ ID NO: 10067619 - DNA, 22 bp, Homo sapiens
tctgcacagctcacctccctgg

SEQ ID NO: 10067620 - DNA, 22 bp, Homo sapiens
tctgcacagattctctgagaat

SEQ ID NO: 10067621 - DNA, 22 bp, Homo sapiens
tctgcacagagacccttgccag

SEQ ID NO: 10067622 - DNA, 22 bp, Homo sapiens
tctgcacatggcgctggtcctg

SEQ ID NO: 10067623 - DNA, 22 bp, Homo sapiens
tctgcacatgtagtaaatatta

SEQ ID NO: 10067624 - DNA, 22 bp, Homo sapiens
tctgcacattttaccaatactc

SEQ ID NO: 10067625 - DNA, 22 bp, Homo sapiens
tcttccttttgtaccttctgaa

SEQ ID NO: 10067626 - DNA, 22 bp, Homo sapiens
tcttctcctttgccatgtgttt

SEQ ID NO: 10067627 - DNA, 22 bp, Homo sapiens
tcttctcatagctagttcttcc

SEQ ID NO: 10067628 - DNA, 22 bp, Homo sapiens
tcttctccagtgcttctgcaca

SEQ ID NO: 10067629 - DNA, 22 bp, Homo sapiens
tcttctcccatcggccgcaggg

SEQ ID NO: 10067630 - DNA, 22 bp, Homo sapiens
tcttctcccatctccaggcagg

SEQ ID NO: 10067631 - DNA, 22 bp, Homo sapiens
tcttgggcatgtgtttgatttc

SEQ ID NO: 10067632 - DNA, 22 bp, Homo sapiens
tctgtgataggtggcatagtga

SEQ ID NO: 10067633 - DNA, 22 bp, Homo sapiens
tctgtgctcatgcatgtgaatt

SEQ ID NO: 10067634 - DNA, 22 bp, Homo sapiens
tctgtgggtgcctccagcagtg

SEQ ID NO: 10067635 - DNA, 22 bp, Homo sapiens
tctgggctttgtaatgggaggt

SEQ ID NO: 10067636 - DNA, 22 bp, Homo sapiens
tctgtccctgagagctcaggag

SEQ ID NO: 10067637 - DNA, 22 bp, Homo sapiens
tctgtcctccggagctcccagt

SEQ ID NO: 10067638 - DNA, 22 bp, Homo sapiens
tctcttctgacctagccttgga

SEQ ID NO: 10067639 - DNA, 22 bp, Homo sapiens
tctctcttgtcaccccatctgc

SEQ ID NO: 10067640 - DNA, 22 bp, Homo sapiens
tctctctcagccattacagaac

SEQ ID NO: 10067641 - DNA, 22 bp, Homo sapiens
tctcctctcttacctggtacaa

SEQ ID NO: 10067642 - DNA, 22 bp, Homo sapiens
tctcctctcctttcatgttgtt

SEQ ID NO: 10067643 - DNA, 22 bp, Homo sapiens
tctcctctgtgccacagcttgg

SEQ ID NO: 10067644 - DNA, 22 bp, Homo sapiens
tctcctcaccaccagcagcaga

SEQ ID NO: 10067645 - DNA, 23 bp, Homo sapiens
tctcctcctagatacagtcatgg

SEQ ID NO: 10067646 - DNA, 21 bp, Homo sapiens
tctcctcccggggagaggccg

SEQ ID NO: 10067647 - DNA, 22 bp, Homo sapiens
tctcctctactgggtctgcaga

SEQ ID NO: 10067648 - DNA, 22 bp, Homo sapiens
tctcctgctcccaactgctgca

SEQ ID NO: 10067649 - DNA, 22 bp, Homo sapiens
tctcctgcttcaactgatggac

SEQ ID NO: 10067650 - DNA, 22 bp, Homo sapiens
tctcctgctcccaactgctgca

SEQ ID NO: 10067651 - DNA, 22 bp, Homo sapiens
tctccttcgaggcccagctccc

SEQ ID NO: 10067652 - DNA, 22 bp, Homo sapiens
tctccttgacaggcaggcagac

SEQ ID NO: 10067653 - DNA, 22 bp, Homo sapiens
tctccttgctacccagtatgtc

SEQ ID NO: 10067654 - DNA, 22 bp, Homo sapiens
tctcctttctggagcctgctca

SEQ ID NO: 10067655 - DNA, 22 bp, Homo sapiens
tctccttgtgctgggtccttcc

SEQ ID NO: 10067656 - DNA, 22 bp, Homo sapiens
tctcctactcactcaaggcttg

SEQ ID NO: 10067657 - DNA, 22 bp, Homo sapiens
tctcccctccctggaccagtgc

SEQ ID NO: 10067658 - DNA, 22 bp, Homo sapiens
tctcccctactctaaatctgca

SEQ ID NO: 10067659 - DNA, 22 bp, Homo sapiens
tctcccagtgtctggcagtcag

SEQ ID NO: 10067660 - DNA, 22 bp, Homo sapiens
tctcccaggtgggtgcctggag

SEQ ID NO: 10067661 - DNA, 22 bp, Homo sapiens
tctcccagaggatcccagtgga

SEQ ID NO: 10067662 - DNA, 22 bp, Homo sapiens
tctccaggtggggtcacctttt

SEQ ID NO: 10067663 - DNA, 22 bp, Homo sapiens
tctccaggttcagtcgatggaa

SEQ ID NO: 10067664 - DNA, 22 bp, Homo sapiens
tctcccactgcaagcccaggct

SEQ ID NO: 10067665 - DNA, 22 bp, Homo sapiens
tctccaggtgaaacttgcaggg

SEQ ID NO: 10067666 - DNA, 22 bp, Homo sapiens
tctccaggtgctaagtgtgcct

SEQ ID NO: 10067667 - DNA, 22 bp, Homo sapiens
tctccaggcttaatctcagctt

SEQ ID NO: 10067668 - DNA, 22 bp, Homo sapiens
tctccaggcctttcccatctta

SEQ ID NO: 10067669 - DNA, 22 bp, Homo sapiens
tctccagggaggtagcccagtg

SEQ ID NO: 10067670 - DNA, 22 bp, Homo sapiens
tctccaggtaaatggcatcctg

SEQ ID NO: 10067671 - DNA, 22 bp, Homo sapiens
tctcagggctcagagctcaggc

SEQ ID NO: 10067672 - DNA, 22 bp, Homo sapiens
tctccaggactgagctccagcc

SEQ ID NO: 10067673 - DNA, 23 bp, Homo sapiens
tctccaggccttactccaggcct

SEQ ID NO: 10067674 - DNA, 22 bp, Homo sapiens
tctccaggagcaagtcacccag

SEQ ID NO: 10067675 - DNA, 22 bp, Homo sapiens
tctcaggcttcctggtgctgtg

SEQ ID NO: 10067676 - DNA, 22 bp, Homo sapiens
tctcaggcttcctggtgctgtg

SEQ ID NO: 10067677 - DNA, 22 bp, Homo sapiens
tctcagggcctccctctgtttc

SEQ ID NO: 10067678 - DNA, 22 bp, Homo sapiens
tctcagggcaattctcagcgac

SEQ ID NO: 10067679 - DNA, 22 bp, Homo sapiens
tctcagggaggttccccgttct

SEQ ID NO: 10067680 - DNA, 20 bp, Homo sapiens
tctcaggccccctccttgct

SEQ ID NO: 10067681 - DNA, 22 bp, Homo sapiens
tctcagaggtcttcagcctctg

SEQ ID NO: 10067682 - DNA, 22 bp, Homo sapiens
tctcagagggaaacatgagtga

SEQ ID NO: 10067683 - DNA, 22 bp, Homo sapiens
tctcagaggcccgacgttctcc

SEQ ID NO: 10067684 - DNA, 22 bp, Homo sapiens
tctcagagtggtggtccctctg

SEQ ID NO: 10067685 - DNA, 22 bp, Homo sapiens
tctcagagttcctctggagtcc

SEQ ID NO: 10067686 - DNA, 22 bp, Homo sapiens
tctcagagattttgtttccctt

SEQ ID NO: 10067687 - DNA, 22 bp, Homo sapiens
tctcagaaatactatgttgtca

SEQ ID NO: 10067688 - DNA, 22 bp, Homo sapiens
tctcagaacacccttctatggt

SEQ ID NO: 10067689 - DNA, 22 bp, Homo sapiens
tctcacagtatgaattgttcac

SEQ ID NO: 10067690 - DNA, 22 bp, Homo sapiens
tctcactcatttcctaggtctt

SEQ ID NO: 10067691 - DNA, 22 bp, Homo sapiens
tccttaggaaaatgatgagggg

SEQ ID NO: 10067692 - DNA, 22 bp, Homo sapiens
tccttgccctaaatgtctgtgt

SEQ ID NO: 10067693 - DNA, 21 bp, Homo sapiens
tccttgggcagtgcccagctt

SEQ ID NO: 10067694 - DNA, 23 bp, Homo sapiens
tctagaaaatgaaagaatgcagt

SEQ ID NO: 10067695 - DNA, 22 bp, Homo sapiens
tcctggagaaactcagagatct

SEQ ID NO: 10067696 - DNA, 18 bp, Homo sapiens
tcctgtggcccagagttt

SEQ ID NO: 10067697 - DNA, 22 bp, Homo sapiens
tcctgtgggctctcggcctcca

SEQ ID NO: 10067698 - DNA, 17 bp, Homo sapiens
tcctgtgggtgcagcag

SEQ ID NO: 10067699 - DNA, 22 bp, Homo sapiens
tcctgggagtaattgagtcatg

SEQ ID NO: 10067700 - DNA, 18 bp, Homo sapiens
tcctgggaaaggcataca

SEQ ID NO: 10067701 - DNA, 22 bp, Homo sapiens
tcctggctgttagagaggcaag

SEQ ID NO: 10067702 - DNA, 22 bp, Homo sapiens
tcctgggaccgagggaagagct

SEQ ID NO: 10067703 - DNA, 22 bp, Homo sapiens
tcctgggaccctgggtgcagag

SEQ ID NO: 10067704 - DNA, 18 bp, Homo sapiens
tgagagcattcgaggcaa

SEQ ID NO: 10067705 - DNA, 22 bp, Homo sapiens
tgagatggcaacaccagctttg

SEQ ID NO: 10067706 - DNA, 22 bp, Homo sapiens
tgagatgaataactcctgctaa

SEQ ID NO: 10067707 - DNA, 22 bp, Homo sapiens
tgagaacatacaaacagagaaa

SEQ ID NO: 10067708 - DNA, 22 bp, Homo sapiens
tgagaaccaagaccaagggcct

SEQ ID NO: 10067709 - DNA, 22 bp, Homo sapiens
tgagaagcattaggaagaacat

SEQ ID NO: 10067710 - DNA, 23 bp, Homo sapiens
tgagaagccaggggagcgtgagg

SEQ ID NO: 10067711 - DNA, 22 bp, Homo sapiens
tgagaaaagtacatggagaagc

SEQ ID NO: 10067712 - DNA, 22 bp, Homo sapiens
tgagaagctctgaaacagtatc

SEQ ID NO: 10067713 - DNA, 22 bp, Homo sapiens
tgagacagcctctgcactcatg

SEQ ID NO: 10067714 - DNA, 22 bp, Homo sapiens
tgagcagcttctgtctgaaggc

SEQ ID NO: 10067715 - DNA, 22 bp, Homo sapiens
tgagcaggactgaccggcctta

SEQ ID NO: 10067716 - DNA, 22 bp, Homo sapiens
tgagcagcaggatcttctggta

SEQ ID NO: 10067717 - DNA, 22 bp, Homo sapiens
tgagcagcccttcctccggcca

SEQ ID NO: 10067718 - DNA, 22 bp, Homo sapiens
tgagcagcaactgtccatggca

SEQ ID NO: 10067719 - DNA, 22 bp, Homo sapiens
tgagcagctactgtgttcaggg

SEQ ID NO: 10067720 - DNA, 22 bp, Homo sapiens
tgagcaggctcccacttcagtg

SEQ ID NO: 10067721 - DNA, 22 bp, Homo sapiens
tgagcaggcaaacaatggttat

SEQ ID NO: 10067722 - DNA, 22 bp, Homo sapiens
tgagcaggagataaacaggtag

SEQ ID NO: 10067723 - DNA, 20 bp, Homo sapiens
tgagcaccaagaatcaagaa

SEQ ID NO: 10067724 - DNA, 22 bp, Homo sapiens
tgagcaccaggcaccacagctc

SEQ ID NO: 10067725 - DNA, 22 bp, Homo sapiens
tgagcaagacccggcctctgcc

SEQ ID NO: 10067726 - DNA, 22 bp, Homo sapiens
tgagcagagcagtaacaggagc

SEQ ID NO: 10067727 - DNA, 22 bp, Homo sapiens
tgaggcctgacagaccaagcct

SEQ ID NO: 10067728 - DNA, 22 bp, Homo sapiens
tgaggcctgaagcctggagcct

SEQ ID NO: 10067729 - DNA, 21 bp, Homo sapiens
tgaggcctctcctgggctggc

SEQ ID NO: 10067730 - DNA, 22 bp, Homo sapiens
tgaggcctgaagcctgaagtga

SEQ ID NO: 10067731 - DNA, 22 bp, Homo sapiens
tgaggcagctttttctgtgtgt

SEQ ID NO: 10067732 - DNA, 22 bp, Homo sapiens
tgaggcctggagggaggagttt

SEQ ID NO: 10067733 - DNA, 22 bp, Homo sapiens
tgaggcctggactctgcatgga

SEQ ID NO: 10067734 - DNA, 22 bp, Homo sapiens
tgaggccttttctgtctggcta

SEQ ID NO: 10067735 - DNA, 22 bp, Homo sapiens
tgaggggaggttggggcacatc

SEQ ID NO: 10067736 - DNA, 19 bp, Homo sapiens
tgaggggaggagaggcctg

SEQ ID NO: 10067737 - DNA, 22 bp, Homo sapiens
tgaggggagaagcagcagcctg

SEQ ID NO: 10067738 - DNA, 22 bp, Homo sapiens
tgagggactgcatacccagctt

SEQ ID NO: 10067739 - DNA, 22 bp, Homo sapiens
tgagggaatcctcacatcaatc

SEQ ID NO: 10067740 - DNA, 22 bp, Homo sapiens
tgacagcataacactggtcttg

SEQ ID NO: 10067741 - DNA, 22 bp, Homo sapiens
tgacacaaaggaaagcataatc

SEQ ID NO: 10067742 - DNA, 22 bp, Homo sapiens
tgaataattatgggagtcctaa

SEQ ID NO: 10067743 - DNA, 22 bp, Homo sapiens
tgaatatgctttgcaatcctaa

SEQ ID NO: 10067744 - DNA, 22 bp, Homo sapiens
tgaagccacagagcatctgcct

SEQ ID NO: 10067745 - DNA, 22 bp, Homo sapiens
tgaaggcacagtttaaccagta

SEQ ID NO: 10067746 - DNA, 22 bp, Homo sapiens
tgaaggcaaaacatgttacacc

SEQ ID NO: 10067747 - DNA, 20 bp, Homo sapiens
tgaaaaggtcaggagacatg

SEQ ID NO: 10067748 - DNA, 22 bp, Homo sapiens
tgaaaagggtagatccctaagt

SEQ ID NO: 10067749 - DNA, 22 bp, Homo sapiens
tgccagtccattgcctgcgttc

SEQ ID NO: 10067750 - DNA, 23 bp, Homo sapiens
tgcccagtgggtgcagggggtat

SEQ ID NO: 10067751 - DNA, 22 bp, Homo sapiens
tgcccccagacagaatccagtt

SEQ ID NO: 10067752 - DNA, 22 bp, Homo sapiens
tgcccagggtggagtgcagcgg

SEQ ID NO: 10067753 - DNA, 22 bp, Homo sapiens
tgcccagggataagcctagaga

SEQ ID NO: 10067754 - DNA, 22 bp, Homo sapiens
tgcccaagccgagctctctgtt

SEQ ID NO: 10067755 - DNA, 22 bp, Homo sapiens
tgcctgcatcttggaggcccca

SEQ ID NO: 10067756 - DNA, 22 bp, Homo sapiens
tgcctgcttgtgtacctggtga

SEQ ID NO: 10067757 - DNA, 22 bp, Homo sapiens
tgcctgcttgtttacctactcc

SEQ ID NO: 10067758 - DNA, 22 bp, Homo sapiens
tgcctgctgccactgctgttac

SEQ ID NO: 10067759 - DNA, 22 bp, Homo sapiens
tgcctcctctttgccaaggtca

SEQ ID NO: 10067760 - DNA, 22 bp, Homo sapiens
tgcctcaagccctccactgcac

SEQ ID NO: 10067761 - DNA, 22 bp, Homo sapiens
tgcagggcatctttgaagtgtg

SEQ ID NO: 10067762 - DNA, 22 bp, Homo sapiens
tgcagggctataactccattct

SEQ ID NO: 10067763 - DNA, 22 bp, Homo sapiens
tgcagggctacaggactacaac

SEQ ID NO: 10067764 - DNA, 22 bp, Homo sapiens
tgcagggctcctggctccaatc

SEQ ID NO: 10067765 - DNA, 22 bp, Homo sapiens
tgcagggccgctggaggtcatg

SEQ ID NO: 10067766 - DNA, 22 bp, Homo sapiens
tgcagggccctcattcctgtcc

SEQ ID NO: 10067767 - DNA, 22 bp, Homo sapiens
tgcagggcccttggggttgaac

SEQ ID NO: 10067768 - DNA, 22 bp, Homo sapiens
tgcaggctggaggagggactaa

SEQ ID NO: 10067769 - DNA, 22 bp, Homo sapiens
tgcaggctgctggcagtagctt

SEQ ID NO: 10067770 - DNA, 22 bp, Homo sapiens
tgcaggctccatgaggacaggc

SEQ ID NO: 10067771 - DNA, 22 bp, Homo sapiens
tgcaggctctctgctgccagat

SEQ ID NO: 10067772 - DNA, 20 bp, Homo sapiens
tgcagggctctgcttctctc

SEQ ID NO: 10067773 - DNA, 22 bp, Homo sapiens
tgcatcagtgactgaatatgag

SEQ ID NO: 10067774 - DNA, 22 bp, Homo sapiens
tgcatgtgtcgggcctgtgcta

SEQ ID NO: 10067775 - DNA, 22 bp, Homo sapiens
tgcatgtggacccctggtgcct

SEQ ID NO: 10067776 - DNA, 22 bp, Homo sapiens
tgccagcagaaataaatacttg

SEQ ID NO: 10067777 - DNA, 23 bp, Homo sapiens
tgccagcagggaatgggaaggac

SEQ ID NO: 10067778 - DNA, 21 bp, Homo sapiens
tgccagcatgtaggctagttg

SEQ ID NO: 10067779 - DNA, 22 bp, Homo sapiens
tgccagcagtagcagtaggcca

SEQ ID NO: 10067780 - DNA, 19 bp, Homo sapiens
tgccagcattaggctgaag

SEQ ID NO: 10067781 - DNA, 21 bp, Homo sapiens
tgccagcattaaacagtcatt

SEQ ID NO: 10067782 - DNA, 22 bp, Homo sapiens
tgccagcaccttcctgctccct

SEQ ID NO: 10067783 - DNA, 22 bp, Homo sapiens
tgccagcacaagttaagagatc

SEQ ID NO: 10067784 - DNA, 22 bp, Homo sapiens
tgccagcacttctggctgtctg

SEQ ID NO: 10067785 - DNA, 22 bp, Homo sapiens
tgccagcaagaatagacagtaa

SEQ ID NO: 10067786 - DNA, 22 bp, Homo sapiens
tgccactggggctaggactgtt

SEQ ID NO: 10067787 - DNA, 21 bp, Homo sapiens
tgcacagggcccaggagagcc

SEQ ID NO: 10067788 - DNA, 22 bp, Homo sapiens
tgcagaaccccttcccaggccc

SEQ ID NO: 10067789 - DNA, 22 bp, Homo sapiens
tgcagaagatggtctgagcacc

SEQ ID NO: 10067790 - DNA, 22 bp, Homo sapiens
tgcagaatttagggaggcagca

SEQ ID NO: 10067791 - DNA, 23 bp, Homo sapiens
tgcaggctaggaagagagccttc

SEQ ID NO: 10067792 - DNA, 22 bp, Homo sapiens
tgcaggctcacctgccagggcc

SEQ ID NO: 10067793 - DNA, 22 bp, Homo sapiens
tgattaagcaaagagcagtaaa

SEQ ID NO: 10067794 - DNA, 22 bp, Homo sapiens
tgatgaataaacttgagagtca

SEQ ID NO: 10067795 - DNA, 22 bp, Homo sapiens
tgatgaatcctctatgcctttt

SEQ ID NO: 10067796 - DNA, 22 bp, Homo sapiens
tgatccctcacttctctttggg

SEQ ID NO: 10067797 - DNA, 22 bp, Homo sapiens
tgatcccttctccttcccttgg

SEQ ID NO: 10067798 - DNA, 22 bp, Homo sapiens
tgatccctgattgccttgactc

SEQ ID NO: 10067799 - DNA, 20 bp, Homo sapiens
tgatccctggcggcctttcc

SEQ ID NO: 10067800 - DNA, 21 bp, Homo sapiens
tgatcacatgaaaaccatgca

SEQ ID NO: 10067801 - DNA, 22 bp, Homo sapiens
tgagttagtcactttgtacatc

SEQ ID NO: 10067802 - DNA, 22 bp, Homo sapiens
tgagttagaggctgtattagtt

SEQ ID NO: 10067803 - DNA, 22 bp, Homo sapiens
tgcaaagatgaaatattaaagg

SEQ ID NO: 10067804 - DNA, 22 bp, Homo sapiens
tgtggggactgagtggaggctt

SEQ ID NO: 10067805 - DNA, 22 bp, Homo sapiens
tgtgagcaagtttatgtgtaca

SEQ ID NO: 10067806 - DNA, 22 bp, Homo sapiens
tgtgagcaagtgactggtgaga

SEQ ID NO: 10067807 - DNA, 22 bp, Homo sapiens
tgtgagcactatggctaggctc

SEQ ID NO: 10067808 - DNA, 22 bp, Homo sapiens
tgtgagcactgtgatgctgttc

SEQ ID NO: 10067809 - DNA, 22 bp, Homo sapiens
tgtgacttaatccttgggtggg

SEQ ID NO: 10067810 - DNA, 21 bp, Homo sapiens
tgtgagaagagtactgaggtc

SEQ ID NO: 10067811 - DNA, 22 bp, Homo sapiens
tgtgagaaatataggccgtgct

SEQ ID NO: 10067812 - DNA, 22 bp, Homo sapiens
tgtgaatagattgaagctttgg

SEQ ID NO: 10067813 - DNA, 22 bp, Homo sapiens
tgtgcagcaaaatagaatcttt

SEQ ID NO: 10067814 - DNA, 22 bp, Homo sapiens
tgtgcagagtaaggcagctgtt

SEQ ID NO: 10067815 - DNA, 22 bp, Homo sapiens
tgtgcagagcggggaagagcac

SEQ ID NO: 10067816 - DNA, 22 bp, Homo sapiens
tgtctcctgggtcccttccacc

SEQ ID NO: 10067817 - DNA, 22 bp, Homo sapiens
tgtctcctgcaggggtgtgggc

SEQ ID NO: 10067818 - DNA, 22 bp, Homo sapiens
tgtctcctctgtcctgtcagga

SEQ ID NO: 10067819 - DNA, 22 bp, Homo sapiens
tgtctcctcggctgtccagcca

SEQ ID NO: 10067820 - DNA, 22 bp, Homo sapiens
tgtctcctcaactcatgctcga

SEQ ID NO: 10067821 - DNA, 22 bp, Homo sapiens
tgtcttccatggttttgacact

SEQ ID NO: 10067822 - DNA, 22 bp, Homo sapiens
ttagaaaggttttgctctgaaa

SEQ ID NO: 10067823 - DNA, 22 bp, Homo sapiens
tgggctggcccaccacacctcg

SEQ ID NO: 10067824 - DNA, 22 bp, Homo sapiens
tgggctgtggagaggagctgga

SEQ ID NO: 10067825 - DNA, 22 bp, Homo sapiens
tggggaagggcaccctggagac

SEQ ID NO: 10067826 - DNA, 22 bp, Homo sapiens
tggggagtgatgcctcggataa

SEQ ID NO: 10067827 - DNA, 22 bp, Homo sapiens
tggggagtcgctgcagagcgat

SEQ ID NO: 10067828 - DNA, 22 bp, Homo sapiens
tggggacattcatgcaggttgt

SEQ ID NO: 10067829 - DNA, 22 bp, Homo sapiens
tggggacatagccagtctggct

SEQ ID NO: 10067830 - DNA, 22 bp, Homo sapiens
tggggcctggtcagagctgcac

SEQ ID NO: 10067831 - DNA, 22 bp, Homo sapiens
tgggggctagaacccagggatt

SEQ ID NO: 10067832 - DNA, 22 bp, Homo sapiens
tgggggagccttcacagtagct

SEQ ID NO: 10067833 - DNA, 22 bp, Homo sapiens
tgggttaggaaggggtatcacc

SEQ ID NO: 10067834 - DNA, 22 bp, Homo sapiens
tgggttcagatcccagctctgt

SEQ ID NO: 10067835 - DNA, 22 bp, Homo sapiens
tggggttgaagaaaggatctag

SEQ ID NO: 10067836 - DNA, 22 bp, Homo sapiens
tggggttgcctcccgccctgga

SEQ ID NO: 10067837 - DNA, 22 bp, Homo sapiens
tgggggtgaaagtctggacagt

SEQ ID NO: 10067838 - DNA, 22 bp, Homo sapiens
tgggcagggagctggaaccaca

SEQ ID NO: 10067839 - DNA, 22 bp, Homo sapiens
tgggcagggatctcttttgcaa

SEQ ID NO: 10067840 - DNA, 19 bp, Homo sapiens
tgggcaggttcagtaatgg

SEQ ID NO: 10067841 - DNA, 22 bp, Homo sapiens
tgggcaggtgctattttccatg

SEQ ID NO: 10067842 - DNA, 22 bp, Homo sapiens
tgggcagggtctctgttatcag

SEQ ID NO: 10067843 - DNA, 22 bp, Homo sapiens
tgggcaggggccctgcttccgt

SEQ ID NO: 10067844 - DNA, 22 bp, Homo sapiens
tgggcaggttgttatttgacat

SEQ ID NO: 10067845 - DNA, 20 bp, Homo sapiens
tgggattgttttttagcttc

SEQ ID NO: 10067846 - DNA, 22 bp, Homo sapiens
tgggcagagagtagaggcaacg

SEQ ID NO: 10067847 - DNA, 22 bp, Homo sapiens
tgggcagagtcatacaggagac

SEQ ID NO: 10067848 - DNA, 22 bp, Homo sapiens
tgggcctcaccttcttggcagc

SEQ ID NO: 10067849 - DNA, 22 bp, Homo sapiens
tgggcctcggagcacaggagac

SEQ ID NO: 10067850 - DNA, 22 bp, Homo sapiens
tgggctcagctcccaagggaag

SEQ ID NO: 10067851 - DNA, 22 bp, Homo sapiens
tgggctctcctggaggacaaca

SEQ ID NO: 10067852 - DNA, 22 bp, Homo sapiens
tgggctctctggcaggaaggct

SEQ ID NO: 10067853 - DNA, 21 bp, Homo sapiens
tgggctctttaacccaggcac

SEQ ID NO: 10067854 - DNA, 22 bp, Homo sapiens
tgtccccaaggttcagcccaca

SEQ ID NO: 10067855 - DNA, 22 bp, Homo sapiens
tggtctctgcaggccaggctca

SEQ ID NO: 10067856 - DNA, 20 bp, Homo sapiens
tggtggccagtgctgcaggc

SEQ ID NO: 10067857 - DNA, 17 bp, Homo sapiens
tggttgtgggaactgaa

SEQ ID NO: 10067858 - DNA, 18 bp, Homo sapiens
tggacagggtggagaaaa

SEQ ID NO: 10067859 - DNA, 22 bp, Homo sapiens
tggactctgaactggcactgac

SEQ ID NO: 10067860 - DNA, 22 bp, Homo sapiens
tggacctgctggatgggcaggt

SEQ ID NO: 10067861 - DNA, 22 bp, Homo sapiens
tggacagaaacccgagtgatct

SEQ ID NO: 10067862 - DNA, 22 bp, Homo sapiens
tgcttctggcagattgagtgag

SEQ ID NO: 10067863 - DNA, 22 bp, Homo sapiens
tgcttgctatgcatcctgaact

SEQ ID NO: 10067864 - DNA, 22 bp, Homo sapiens
tgcttgctcgccgcctgctgac

SEQ ID NO: 10067865 - DNA, 22 bp, Homo sapiens
tgcttgctctccggactctaat

SEQ ID NO: 10067866 - DNA, 22 bp, Homo sapiens
tggaaaggtgtaaagcagaacc

SEQ ID NO: 10067867 - DNA, 22 bp, Homo sapiens
tggaaagggacttatgagttcc

SEQ ID NO: 10067868 - DNA, 22 bp, Homo sapiens
tggaaaggaggcttgtggaata

SEQ ID NO: 10067869 - DNA, 22 bp, Homo sapiens
tggaaaggacagttgctgatag

SEQ ID NO: 10067870 - DNA, 22 bp, Homo sapiens
tggagccagagcgcagcctggg

SEQ ID NO: 10067871 - DNA, 22 bp, Homo sapiens
tggagccactcactatctgagt

SEQ ID NO: 10067872 - DNA, 22 bp, Homo sapiens
tggagccagcccaggcccctct

SEQ ID NO: 10067873 - DNA, 22 bp, Homo sapiens
tggagccaggctggccctgcca

SEQ ID NO: 10067874 - DNA, 22 bp, Homo sapiens
tggagccaatgaacatttgctg

SEQ ID NO: 10067875 - DNA, 22 bp, Homo sapiens
tggagcagctctagcgggcgcc

SEQ ID NO: 10067876 - DNA, 22 bp, Homo sapiens
tggagccataaccctttcgtac

SEQ ID NO: 10067877 - DNA, 18 bp, Homo sapiens
tggagccattgccaccat

SEQ ID NO: 10067878 - DNA, 22 bp, Homo sapiens
tggagcagagatggtggccttc

SEQ ID NO: 10067879 - DNA, 22 bp, Homo sapiens
tggagcagaggaagaaggcttt

SEQ ID NO: 10067880 - DNA, 22 bp, Homo sapiens
tggagaaggccggccaggagtg

SEQ ID NO: 10067881 - DNA, 20 bp, Homo sapiens
tggagttgttctgctaggtc

SEQ ID NO: 10067882 - DNA, 22 bp, Homo sapiens
tggaggccatacctcctgacat

SEQ ID NO: 10067883 - DNA, 22 bp, Homo sapiens
tggaggccggactgagaggcat

SEQ ID NO: 10067884 - DNA, 22 bp, Homo sapiens
tggaggccgaattagagcgttg

SEQ ID NO: 10067885 - DNA, 22 bp, Homo sapiens
tggaggccgcgtagtctgagca

SEQ ID NO: 10067886 - DNA, 22 bp, Homo sapiens
tggaggaaaaaaccaggcagag

SEQ ID NO: 10067887 - DNA, 18 bp, Homo sapiens
tggaggaaaaatctcatg

SEQ ID NO: 10067888 - DNA, 22 bp, Homo sapiens
tgctgccaaatgcgagctctgt

SEQ ID NO: 10067889 - DNA, 22 bp, Homo sapiens
tgctgccacccctcaccagagc

SEQ ID NO: 10067890 - DNA, 21 bp, Homo sapiens
tgctgctgatcggggttggct

SEQ ID NO: 10067891 - DNA, 22 bp, Homo sapiens
tgctgctgggtttgacagtcac

SEQ ID NO: 10067892 - DNA, 22 bp, Homo sapiens
tgctggctgcagtgctgtcaaa

SEQ ID NO: 10067893 - DNA, 22 bp, Homo sapiens
tgctggatggagtaaaactgga

SEQ ID NO: 10067894 - DNA, 22 bp, Homo sapiens
tgctgggctagaagctgaggcc

SEQ ID NO: 10067895 - DNA, 22 bp, Homo sapiens
tgctgtcctgctgagggatgtg

SEQ ID NO: 10067896 - DNA, 22 bp, Homo sapiens
tgctgtcccccgtgtctgggct

SEQ ID NO: 10067897 - DNA, 22 bp, Homo sapiens
tgctgtgacccaaaaaagacct

SEQ ID NO: 10067898 - DNA, 22 bp, Homo sapiens
tgctgtgaggttgagaaggaag

SEQ ID NO: 10067899 - DNA, 22 bp, Homo sapiens
tgctccttcctcatcctgtgca

SEQ ID NO: 10067900 - DNA, 22 bp, Homo sapiens
tgctccttcccttcccagtgag

SEQ ID NO: 10067901 - DNA, 17 bp, Homo sapiens
tgctcctgtggcagcct

SEQ ID NO: 10067902 - DNA, 21 bp, Homo sapiens
tgctccttagctgcccctgcc

SEQ ID NO: 10067903 - DNA, 22 bp, Homo sapiens
tgctcctgtttcatcagctata

SEQ ID NO: 10067904 - DNA, 22 bp, Homo sapiens
tgctcctggactggtgtgagat

SEQ ID NO: 10067905 - DNA, 22 bp, Homo sapiens
tgctcctggctccttccctaac

SEQ ID NO: 10067906 - DNA, 22 bp, Homo sapiens
tgctcctggcatctctgcgtcc

SEQ ID NO: 10067907 - DNA, 22 bp, Homo sapiens
tgctcctggcttcaggttgggc

SEQ ID NO: 10067908 - DNA, 22 bp, Homo sapiens
tgctcctgagggataaactgcc

SEQ ID NO: 10067909 - DNA, 22 bp, Homo sapiens
tgctcctgaattacactactac

SEQ ID NO: 10067910 - DNA, 22 bp, Homo sapiens
tgctcctgctggccctcgtgcc

SEQ ID NO: 10067911 - DNA, 22 bp, Homo sapiens
tgctcctgcttagccgtgtttt

SEQ ID NO: 10067912 - DNA, 22 bp, Homo sapiens
tgctcctgctcctcccggttga

SEQ ID NO: 10067913 - DNA, 22 bp, Homo sapiens
tgctcctgccgtggtcgggact

SEQ ID NO: 10067914 - DNA, 22 bp, Homo sapiens
tgctcctgatatctaatgtgta

SEQ ID NO: 10067915 - DNA, 22 bp, Homo sapiens
tgctcccttgccagaggggaag

SEQ ID NO: 10067916 - DNA, 22 bp, Homo sapiens
tgctcccagggactctggctgg

SEQ ID NO: 10067917 - DNA, 22 bp, Homo sapiens
tgctcagaaacgaggtgcagcc

SEQ ID NO: 10067918 - DNA, 22 bp, Homo sapiens
tgctcagaattgcgctggtgga

SEQ ID NO: 10067919 - DNA, 22 bp, Homo sapiens
tgctcagagctctggtgcaggt

SEQ ID NO: 10067920 - DNA, 22 bp, Homo sapiens
tgcctgggggactaaggccaaa

SEQ ID NO: 10067921 - DNA, 22 bp, Homo sapiens
tgcctggggattgctctgggcc

SEQ ID NO: 10067922 - DNA, 22 bp, Homo sapiens
tggccttggccgtgctggggtc

SEQ ID NO: 10067923 - DNA, 22 bp, Homo sapiens
tggctcaagtgatcctcctgcc

SEQ ID NO: 10067924 - DNA, 22 bp, Homo sapiens
tggctcagaactacttctagtt

SEQ ID NO: 10067925 - DNA, 22 bp, Homo sapiens
tggctcagagcagggactctgg

SEQ ID NO: 10067926 - DNA, 22 bp, Homo sapiens
tggctcagagccttgagagctg

SEQ ID NO: 10067927 - DNA, 22 bp, Homo sapiens
tggctcagaaggctgccttcac

SEQ ID NO: 10067928 - DNA, 22 bp, Homo sapiens
tggctcagaagaaaaggtaaac

SEQ ID NO: 10067929 - DNA, 22 bp, Homo sapiens
tggctcagagagggagtgtgga

SEQ ID NO: 10067930 - DNA, 18 bp, Homo sapiens
tggctcagatggctttaa

SEQ ID NO: 10067931 - DNA, 22 bp, Homo sapiens
tggctcagatttttgtaggctt

SEQ ID NO: 10067932 - DNA, 22 bp, Homo sapiens
tggctcagataattcaaggggc

SEQ ID NO: 10067933 - DNA, 22 bp, Homo sapiens
tggctcagatgctcttccagtg

SEQ ID NO: 10067934 - DNA, 22 bp, Homo sapiens
tggctcagaggggaagtggttt

SEQ ID NO: 10067935 - DNA, 22 bp, Homo sapiens
tggctcagagttcatcttttag

SEQ ID NO: 10067936 - DNA, 22 bp, Homo sapiens
tggctcagccagccctaggaac

SEQ ID NO: 10067937 - DNA, 22 bp, Homo sapiens
tggctcagcattcactggtctt

SEQ ID NO: 10067938 - DNA, 22 bp, Homo sapiens
tggctcagcaagacattgacct

SEQ ID NO: 10067939 - DNA, 22 bp, Homo sapiens
tggctcagcaggttagaaacta

SEQ ID NO: 10067940 - DNA, 22 bp, Homo sapiens
tggctcagctttccccatctgg

SEQ ID NO: 10067941 - DNA, 22 bp, Homo sapiens
tggctcagcttacttttgaggg

SEQ ID NO: 10067942 - DNA, 22 bp, Homo sapiens
tggctcaggcttgaaaatagat

SEQ ID NO: 10067943 - DNA, 22 bp, Homo sapiens
tggctcaggcctacgacgcctt

SEQ ID NO: 10067944 - DNA, 22 bp, Homo sapiens
tggctcaggccacttcttttat

SEQ ID NO: 10067945 - DNA, 22 bp, Homo sapiens
tggctcaggagggatctttgct

SEQ ID NO: 10067946 - DNA, 22 bp, Homo sapiens
tggctcaggataattttcccaa

SEQ ID NO: 10067947 - DNA, 22 bp, Homo sapiens
tggctcaggatctaagcagaat

SEQ ID NO: 10067948 - DNA, 23 bp, Homo sapiens
tggctcagggtctcttatgaagt

SEQ ID NO: 10067949 - DNA, 22 bp, Homo sapiens
tggctcagggtccccaaatggt

SEQ ID NO: 10067950 - DNA, 22 bp, Homo sapiens
tggctcaggggtctggctctgt

SEQ ID NO: 10067951 - DNA, 22 bp, Homo sapiens
tggctcagtagcagtgtggtca

SEQ ID NO: 10067952 - DNA, 22 bp, Homo sapiens
tggctcaggtgtgagctgaaga

SEQ ID NO: 10067953 - DNA, 22 bp, Homo sapiens
tggctcagtaatcgagtctcct

SEQ ID NO: 10067954 - DNA, 22 bp, Homo sapiens
tggctcagtggcagccgcagct

SEQ ID NO: 10067955 - DNA, 22 bp, Homo sapiens
tggctcagtgcattcacagtaa

SEQ ID NO: 10067956 - DNA, 22 bp, Homo sapiens
tggctcagtgacattcctccca

SEQ ID NO: 10067957 - DNA, 22 bp, Homo sapiens
tggctcagtctgggttgactga

SEQ ID NO: 10067958 - DNA, 22 bp, Homo sapiens
tggctcagtcatggatgagtaa

SEQ ID NO: 10067959 - DNA, 22 bp, Homo sapiens
tggctcagtgaagagataactt

SEQ ID NO: 10067960 - DNA, 22 bp, Homo sapiens
tggctcagttccatcatctgga

SEQ ID NO: 10067961 - DNA, 22 bp, Homo sapiens
tggctcagttaggtcagaaaca

SEQ ID NO: 10067962 - DNA, 21 bp, Homo sapiens
tggctcagttgctgggcacag

SEQ ID NO: 10067963 - DNA, 22 bp, Homo sapiens
tggctcccacaaactcactact

SEQ ID NO: 10067964 - DNA, 22 bp, Homo sapiens
tggctcccaaggagctcctgcc

SEQ ID NO: 10067965 - DNA, 22 bp, Homo sapiens
tggctcccgcttgcacctaaga

SEQ ID NO: 10067966 - DNA, 21 bp, Homo sapiens
tggctctgctcagagcagtcc

SEQ ID NO: 10067967 - DNA, 22 bp, Homo sapiens
tgggaaagtgtagcctgcaggc

SEQ ID NO: 10067968 - DNA, 22 bp, Homo sapiens
tgggaacattttgagctgagag

SEQ ID NO: 10067969 - DNA, 22 bp, Homo sapiens
tgggaaagactcaggacaggag

SEQ ID NO: 10067970 - DNA, 22 bp, Homo sapiens
tggcttctggctggtgagaaat

SEQ ID NO: 10067971 - DNA, 22 bp, Homo sapiens
tggcttctagtttgaggaaaaa

SEQ ID NO: 10067972 - DNA, 22 bp, Homo sapiens
tgggagacactggtgggagctt

SEQ ID NO: 10067973 - DNA, 22 bp, Homo sapiens
tgggagaaactgtctctcccac

SEQ ID NO: 10067974 - DNA, 22 bp, Homo sapiens
tgggagctctgagcctgctgtg

SEQ ID NO: 10067975 - DNA, 22 bp, Homo sapiens
tgggaagttgtaccttctgtta

SEQ ID NO: 10067976 - DNA, 22 bp, Homo sapiens
tgggaatgtgagcattcattca

SEQ ID NO: 10067977 - DNA, 21 bp, Homo sapiens
tgggacagtgatggctcctcc

SEQ ID NO: 10067978 - DNA, 22 bp, Homo sapiens
tgggaagcacgctcagcagaaa

SEQ ID NO: 10067979 - DNA, 22 bp, Homo sapiens
tggcacagcaagagtttgggaa

SEQ ID NO: 10067980 - DNA, 23 bp, Homo sapiens
tggcacagcaggtgtgctttgtt

SEQ ID NO: 10067981 - DNA, 22 bp, Homo sapiens
tggcacagttaaagttgtagaa

SEQ ID NO: 10067982 - DNA, 22 bp, Homo sapiens
tggcagcagtggaggtagaaag

SEQ ID NO: 10067983 - DNA, 22 bp, Homo sapiens
tggcagcagctaacttaggcag

SEQ ID NO: 10067984 - DNA, 22 bp, Homo sapiens
tggcagcagacatctgaggtct

SEQ ID NO: 10067985 - DNA, 22 bp, Homo sapiens
tggcagcagcaaatggcatatc

SEQ ID NO: 10067986 - DNA, 22 bp, Homo sapiens
tggcagcagacaaaaggccatt

SEQ ID NO: 10067987 - DNA, 22 bp, Homo sapiens
tggcctcttaggacatcctcta

SEQ ID NO: 10067988 - DNA, 20 bp, Homo sapiens
tggcctctgagatgccacgg

SEQ ID NO: 10067989 - DNA, 22 bp, Homo sapiens
tggcctctctaccaggcagcct

SEQ ID NO: 10067990 - DNA, 22 bp, Homo sapiens
tggcagtgaaccaaggctccaa

SEQ ID NO: 10067991 - DNA, 18 bp, Homo sapiens
tggcagtgaggtaggcat

SEQ ID NO: 10067992 - DNA, 22 bp, Homo sapiens
tggcagtgatgcggcaggacat

SEQ ID NO: 10067993 - DNA, 22 bp, Homo sapiens
tggcagtggcgggactcagggc

SEQ ID NO: 10067994 - DNA, 22 bp, Homo sapiens
tggcagtgccccttgaccagtg

SEQ ID NO: 10067995 - DNA, 19 bp, Homo sapiens
tggcagtgtggggtatgaa

SEQ ID NO: 10067996 - DNA, 22 bp, Homo sapiens
tggcatgagaatactgagggat

SEQ ID NO: 10067997 - DNA, 22 bp, Homo sapiens
tggcatgaagtcagcagctggg

SEQ ID NO: 10067998 - DNA, 22 bp, Homo sapiens
tggcatttcagtattttcataa

SEQ ID NO: 10067999 - DNA, 22 bp, Homo sapiens
actgcactccagcctgggtaac

SEQ ID NO: 10068000 - DNA, 22 bp, Homo sapiens
aagaaaacgttttgaggagttt

SEQ ID NO: 10068001 - DNA, 20 bp, Homo sapiens
actttggggtctttctcaga

SEQ ID NO: 10068002 - DNA, 22 bp, Homo sapiens
actttggggaacttttctcctc

SEQ ID NO: 10068003 - DNA, 21 bp, Homo sapiens
actttgggcactttcctgccc

SEQ ID NO: 10068004 - DNA, 22 bp, Homo sapiens
actttgggtaagccaggtgcta

SEQ ID NO: 10068005 - DNA, 22 bp, Homo sapiens
agccaggatggtctcgatcggc

SEQ ID NO: 10068006 - DNA, 22 bp, Homo sapiens
atggcagagggattgaacagct

SEQ ID NO: 10068007 - DNA, 22 bp, Homo sapiens
atgcagaaggagccatgcttgc

SEQ ID NO: 10068008 - DNA, 22 bp, Homo sapiens
atgtctttcaaattctgcctag

SEQ ID NO: 10068009 - DNA, 22 bp, Homo sapiens
atgtctttcttatggtctgttg

SEQ ID NO: 10068010 - DNA, 18 bp, Homo sapiens
ctgtcttttttctctcca

SEQ ID NO: 10068011 - DNA, 22 bp, Homo sapiens
ctgtctttggtcctgtctgtta

SEQ ID NO: 10068012 - DNA, 22 bp, Homo sapiens
ctgtcttttcatactttccctc

SEQ ID NO: 10068013 - DNA, 22 bp, Homo sapiens
ctgggcaggagggctctatgga

SEQ ID NO: 10068014 - DNA, 19 bp, Homo sapiens
aggcagaggcttggctagc

SEQ ID NO: 10068015 - DNA, 23 bp, Homo sapiens
aggagaagagatttccacatgca

SEQ ID NO: 10068016 - DNA, 22 bp, Homo sapiens
cagtcctgagccaatcatgatg

SEQ ID NO: 10068017 - DNA, 22 bp, Homo sapiens
cagtcctgcccaggctgacaga

SEQ ID NO: 10068018 - DNA, 22 bp, Homo sapiens
agggagaaggtttagctgtgag

SEQ ID NO: 10068019 - DNA, 22 bp, Homo sapiens
ccagtctggcaggagggggaac

SEQ ID NO: 10068020 - DNA, 22 bp, Homo sapiens
tctgtcttagcatctttgctca

SEQ ID NO: 10068021 - DNA, 17 bp, Homo sapiens
tctgtcttgactgtcac

SEQ ID NO: 10068022 - DNA, 22 bp, Homo sapiens
cagtcctggggaccaggctgag

SEQ ID NO: 10068023 - DNA, 22 bp, Homo sapiens
cagtcctgtgttaaacaagagc

SEQ ID NO: 10068024 - DNA, 22 bp, Homo sapiens
caggagactatggcccaaggcc

SEQ ID NO: 10068025 - DNA, 22 bp, Homo sapiens
cagctgagcatcactagtctgg

SEQ ID NO: 10068026 - DNA, 22 bp, Homo sapiens
cagctgagtttccaagtctgcc

SEQ ID NO: 10068027 - DNA, 22 bp, Homo sapiens
cagctgagttactctgaggtct

SEQ ID NO: 10068028 - DNA, 22 bp, Homo sapiens
ctctccagatctgctgagccag

SEQ ID NO: 10068029 - DNA, 19 bp, Homo sapiens
ctctccagctccagtagct

SEQ ID NO: 10068030 - DNA, 22 bp, Homo sapiens
ctccagtctagtagagcctgct

SEQ ID NO: 10068031 - DNA, 22 bp, Homo sapiens
tgtctcatctcttaaccccact

SEQ ID NO: 10068032 - DNA, 22 bp, Homo sapiens
cctggcttttgtttataaattc

SEQ ID NO: 10068033 - DNA, 22 bp, Homo sapiens
ggtggttcacgcctataatccc

SEQ ID NO: 10068034 - DNA, 22 bp, Homo sapiens
ggcagagactgggttggcagag

SEQ ID NO: 10068035 - DNA, 19 bp, Homo sapiens
ggcagacacagttgacatg

SEQ ID NO: 10068036 - DNA, 22 bp, Homo sapiens
tggcacatagcaggtactcagt

SEQ ID NO: 10068037 - DNA, 22 bp, Homo sapiens
tggacaacatagtgagacctca

SEQ ID NO: 10068038 - DNA, 22 bp, Homo sapiens
tggtcaacaggcagggatgaaa

SEQ ID NO: 10068039 - DNA, 22 bp, Homo sapiens
ttccagctaactcacatccctt

SEQ ID NO: 10068040 - DNA, 22 bp, Homo sapiens
tgtttttccatgtgcagaacaa

SEQ ID NO: 10068041 - DNA, 21 bp, Homo sapiens
tgtttatggaaaagagacaaa

SEQ ID NO: 10068042 - DNA, 21 bp, Homo sapiens
tgcaatccagcctgggcgaca

SEQ ID NO: 10068043 - DNA, 21 bp, Homo sapiens
tgcaggagtctgtgagtcagg

SEQ ID NO: 10068044 - DNA, 22 bp, Homo sapiens
tgcagctgaggccagctatgcc

SEQ ID NO: 10068045 - DNA, 22 bp, Homo sapiens
tgcacatctttcagcatcatac

SEQ ID NO: 10068046 - DNA, 22 bp, Homo sapiens
tgagatgaataactcctgctaa

SEQ ID NO: 10068047 - DNA, 21 bp, Homo sapiens
tcctgtaagcttgggtggctc

SEQ ID NO: 10068048 - DNA, 22 bp, Homo sapiens
tctgtctttagaggcctgtgct

SEQ ID NO: 10068049 - DNA, 22 bp, Homo sapiens
tctgtctttgagatctcagcct

SEQ ID NO: 10068050 - DNA, 19 bp, Homo sapiens
agactctgccactcttctc

SEQ ID NO: 10068051 - DNA, 19 bp, Homo sapiens
agactctgtgtgagacttt

SEQ ID NO: 10068052 - DNA, 22 bp, Homo sapiens
agactctgataagcaactcttg

SEQ ID NO: 10068053 - DNA, 22 bp, Homo sapiens
agactctgattccctcatgtca

SEQ ID NO: 10068054 - DNA, 22 bp, Homo sapiens
acttttttataaggaagaagat

SEQ ID NO: 10068055 - DNA, 22 bp, Homo sapiens
actgcactcctgcctgggtaac

SEQ ID NO: 10068056 - DNA, 22 bp, Homo sapiens
aggctgtgattccaccactctc

SEQ ID NO: 10068057 - DNA, 22 bp, Homo sapiens
ctgtaatcccagctacctggga

SEQ ID NO: 10068058 - DNA, 22 bp, Homo sapiens
aggcagagctgatgttctgtga

SEQ ID NO: 10068059 - DNA, 22 bp, Homo sapiens
aggcagagctaggaagaattgt

SEQ ID NO: 10068060 - DNA, 20 bp, Homo sapiens
aggcagagcgcacttttaga

SEQ ID NO: 10068061 - DNA, 22 bp, Homo sapiens
aggcagaggaagggtggatttg

SEQ ID NO: 10068062 - DNA, 22 bp, Homo sapiens
aggcagaggagaatgatcttcc

SEQ ID NO: 10068063 - DNA, 22 bp, Homo sapiens
aggcagagctgggttttgaaat

SEQ ID NO: 10068064 - DNA, 22 bp, Homo sapiens
aggcagagagcagtggccgtct

SEQ ID NO: 10068065 - DNA, 16 bp, Homo sapiens
aggcagagatttaccc

SEQ ID NO: 10068066 - DNA, 22 bp, Homo sapiens
aggaaacagtgaacttggcagg

SEQ ID NO: 10068067 - DNA, 22 bp, Homo sapiens
gcagaggctctttaatgcttag

SEQ ID NO: 10068068 - DNA, 22 bp, Homo sapiens
gcagaatgtaggccttcagtgt

SEQ ID NO: 10068069 - DNA, 22 bp, Homo sapiens
gcagaggccatcaactttgcca

SEQ ID NO: 10068070 - DNA, 22 bp, Homo sapiens
tgagtccaagagccagtgggaa

SEQ ID NO: 10068071 - DNA, 22 bp, Homo sapiens
tgagtccaccttagtatatggg

SEQ ID NO: 10068072 - DNA, 22 bp, Homo sapiens
ccagtctgaggcctggtgaggg

SEQ ID NO: 10068073 - DNA, 22 bp, Homo sapiens
tcttttgagggccagaggaaga

SEQ ID NO: 10068074 - DNA, 22 bp, Homo sapiens
tggcttgtcatgtatctgaggc

SEQ ID NO: 10068075 - DNA, 19 bp, Homo sapiens
catggtgaaaccccgtctc

SEQ ID NO: 10068076 - DNA, 22 bp, Homo sapiens
ctgtctgtcaccaaaacagact

SEQ ID NO: 10068077 - DNA, 22 bp, Homo sapiens
tttttctgccattcaaagagga

SEQ ID NO: 10068078 - DNA, 22 bp, Homo sapiens
ctcaggagtagttcagcagctg

SEQ ID NO: 10068079 - DNA, 22 bp, Homo sapiens
ttctgtctccctgatgtagagc

SEQ ID NO: 10068080 - DNA, 22 bp, Homo sapiens
ttctcaggtgaggctgaggctg

SEQ ID NO: 10068081 - DNA, 22 bp, Homo sapiens
cctgtactagggtctcattgcc

SEQ ID NO: 10068082 - DNA, 22 bp, Homo sapiens
cctgtattaggtagacaactat

SEQ ID NO: 10068083 - DNA, 22 bp, Homo sapiens
tcccagcacgtctgctgtttct

SEQ ID NO: 10068084 - DNA, 22 bp, Homo sapiens
tccagtctctactctgagataa

SEQ ID NO: 10068085 - DNA, 20 bp, Homo sapiens
tcaggtagatctttgaggtc

SEQ ID NO: 10068086 - DNA, 22 bp, Homo sapiens
tcaggagatgtaaccttagctg

SEQ ID NO: 10068087 - DNA, 22 bp, Homo sapiens
tcaggaaagagtgtatccatca

SEQ ID NO: 10068088 - DNA, 22 bp, Homo sapiens
gctgtgagctgcctgtgtcaca

SEQ ID NO: 10068089 - DNA, 22 bp, Homo sapiens
ggcagcagggtctagattgatg

SEQ ID NO: 10068090 - DNA, 22 bp, Homo sapiens
ggcaggagctctccagtttgcc

SEQ ID NO: 10068091 - DNA, 22 bp, Homo sapiens
gtaatctcagctacttgggagg

SEQ ID NO: 10068092 - DNA, 21 bp, Homo sapiens
tttatttatataggacacatg

SEQ ID NO: 10068093 - DNA, 23 bp, Homo sapiens
ttttccagaatcgactctgtaga

SEQ ID NO: 10068094 - DNA, 22 bp, Homo sapiens
actgcagactctacagttataa

SEQ ID NO: 10068095 - DNA, 23 bp, Homo sapiens
cagaggcatcggattcaacatca

SEQ ID NO: 10068096 - DNA, 22 bp, Homo sapiens
acatgtgtggacatgaatctac

SEQ ID NO: 10068097 - DNA, 21 bp, Homo sapiens
accatcttccatgcattatat

SEQ ID NO: 10068098 - DNA, 22 bp, Homo sapiens
accatcttagtggccagctctc

SEQ ID NO: 10068099 - DNA, 22 bp, Homo sapiens
atggcagaattaggatttcaag

SEQ ID NO: 10068100 - DNA, 22 bp, Homo sapiens
caatagtaaattacggaggaga

SEQ ID NO: 10068101 - DNA, 22 bp, Homo sapiens
ggcagaggtgacagtgtctttt

SEQ ID NO: 10068102 - DNA, 22 bp, Homo sapiens
cagctgagaagtgatagctgca

SEQ ID NO: 10068103 - DNA, 20 bp, Homo sapiens
agggcagagggattacaggc

SEQ ID NO: 10068104 - DNA, 22 bp, Homo sapiens
ctcaggagttggaggctacagt

SEQ ID NO: 10068105 - DNA, 22 bp, Homo sapiens
ctgtaatcccagctactcggga

SEQ ID NO: 10068106 - DNA, 22 bp, Homo sapiens
tcaggaaaatactgcttatcca

SEQ ID NO: 10068107 - DNA, 22 bp, Homo sapiens
tgtattccaaaatgctgaggat

SEQ ID NO: 10068108 - DNA, 22 bp, Homo sapiens
tgtaagtagtaatggaaggaca

SEQ ID NO: 10068109 - DNA, 22 bp, Homo sapiens
ccggctactcgggaggctgacg

SEQ ID NO: 10068110 - DNA, 22 bp, Homo sapiens
tggctaacaaggtgaaaccccg

SEQ ID NO: 10068111 - DNA, 22 bp, Homo sapiens
tgaaggaaatgacggcagaaga

SEQ ID NO: 10068112 - DNA, 22 bp, Homo sapiens
ctcaggagacagtgtccacatg

SEQ ID NO: 10068113 - DNA, 22 bp, Homo sapiens
ctcaggagagtcttatatctcc

SEQ ID NO: 10068114 - DNA, 22 bp, Homo sapiens
ctcaggaggtggtagaggccct

SEQ ID NO: 10068115 - DNA, 22 bp, Homo sapiens
ctcaggaggtttcctgtctagg

SEQ ID NO: 10068116 - DNA, 22 bp, Homo sapiens
ctcaggagcttcctcagcccat

SEQ ID NO: 10068117 - DNA, 22 bp, Homo sapiens
ctcaggaggaggaagttcattg

SEQ ID NO: 10068118 - DNA, 22 bp, Homo sapiens
ctcaggagatgacagaaggtat

SEQ ID NO: 10068119 - DNA, 22 bp, Homo sapiens
ctcaggaggccattctcaaggt

SEQ ID NO: 10068120 - DNA, 22 bp, Homo sapiens
ctcaggaggatgactgccttgg

SEQ ID NO: 10068121 - DNA, 21 bp, Homo sapiens
ggctgtggagccatgactcac

SEQ ID NO: 10068122 - DNA, 22 bp, Homo sapiens
gtccagctgatcttgacccagc

SEQ ID NO: 10068123 - DNA, 22 bp, Homo sapiens
taaggaaagtacatgttttgac

SEQ ID NO: 10068124 - DNA, 22 bp, Homo sapiens
taaggaaacaacttgtattttt

SEQ ID NO: 10068125 - DNA, 22 bp, Homo sapiens
taaggaaagtgccatgatttct

SEQ ID NO: 10068126 - DNA, 22 bp, Homo sapiens
tcaggagacttatgtcacagtg

SEQ ID NO: 10068127 - DNA, 22 bp, Homo sapiens
tcagaatgaaatttctttcaga

SEQ ID NO: 10068128 - DNA, 22 bp, Homo sapiens
ttctgtctgatggtgccagaac

SEQ ID NO: 10068129 - DNA, 22 bp, Homo sapiens
ttctgtcttcccactgaggagc

SEQ ID NO: 10068130 - DNA, 19 bp, Homo sapiens
aaaaggaatattctttggg

SEQ ID NO: 10068131 - DNA, 19 bp, Homo sapiens
aggctgtgagggaggactc

SEQ ID NO: 10068132 - DNA, 22 bp, Homo sapiens
attttttagaacctggcctgat

SEQ ID NO: 10068133 - DNA, 22 bp, Homo sapiens
atcttaatcgagtccatgaaaa

SEQ ID NO: 10068134 - DNA, 22 bp, Homo sapiens
attgatatcagtttgctgattg

SEQ ID NO: 10068135 - DNA, 22 bp, Homo sapiens
aggcaagaacagacatgggagt

SEQ ID NO: 10068136 - DNA, 22 bp, Homo sapiens
aggctgtgcacagggcacctgc

SEQ ID NO: 10068137 - DNA, 22 bp, Homo sapiens
aggctgtgacagggtcatggag

SEQ ID NO: 10068138 - DNA, 22 bp, Homo sapiens
ctccagctttttcccagttggc

SEQ ID NO: 10068139 - DNA, 22 bp, Homo sapiens
ctccagctgccaccagatgttt

SEQ ID NO: 10068140 - DNA, 22 bp, Homo sapiens
ctccagcttccctcagctgtgg

SEQ ID NO: 10068141 - DNA, 22 bp, Homo sapiens
atacaaagctttctgtctggta

SEQ ID NO: 10068142 - DNA, 22 bp, Homo sapiens
atacaaagtattaatcctggat

SEQ ID NO: 10068143 - DNA, 22 bp, Homo sapiens
atagcagaaaccaagcttcttc

SEQ ID NO: 10068144 - DNA, 22 bp, Homo sapiens
atacctgtgtatccacaagcgt

SEQ ID NO: 10068145 - DNA, 22 bp, Homo sapiens
tccatattaactaaaactagaa

SEQ ID NO: 10068146 - DNA, 22 bp, Homo sapiens
tccattttagagatgaagaaac

SEQ ID NO: 10068147 - DNA, 22 bp, Homo sapiens
tctaatcctatggtggggaggg

SEQ ID NO: 10068148 - DNA, 22 bp, Homo sapiens
ccagtcctggccagtaacatga

SEQ ID NO: 10068149 - DNA, 22 bp, Homo sapiens
tgagacagttctgcagctgggt

SEQ ID NO: 10068150 - DNA, 22 bp, Homo sapiens
ccaggtggaaggtctgtgctct

SEQ ID NO: 10068151 - DNA, 22 bp, Homo sapiens
ttgtctttggaaatttaatgtt

SEQ ID NO: 10068152 - DNA, 17 bp, Homo sapiens
cctgtcttgtttctgcc

SEQ ID NO: 10068153 - DNA, 21 bp, Homo sapiens
cctgtcttggactgaggcacc

SEQ ID NO: 10068154 - DNA, 20 bp, Homo sapiens
cctgtctggagacaaagaga

SEQ ID NO: 10068155 - DNA, 22 bp, Homo sapiens
gaccctgtttctacaaataatt

SEQ ID NO: 10068156 - DNA, 22 bp, Homo sapiens
ctggcttttagtgtgaagactt

SEQ ID NO: 10068157 - DNA, 22 bp, Homo sapiens
ggcagaggaaggatgaattcac

SEQ ID NO: 10068158 - DNA, 22 bp, Homo sapiens
ggcagaggaggggtgaatttgc

SEQ ID NO: 10068159 - DNA, 22 bp, Homo sapiens
ggcaggaggaagagttagcacc

SEQ ID NO: 10068160 - DNA, 22 bp, Homo sapiens
ggcagaggtagctggaaccagg

SEQ ID NO: 10068161 - DNA, 22 bp, Homo sapiens
gccagcctgtgcttggccaggc

SEQ ID NO: 10068162 - DNA, 22 bp, Homo sapiens
gcggtagctcaagcttgtaatc

SEQ ID NO: 10068163 - DNA, 22 bp, Homo sapiens
tccatctgtttactataaagat

SEQ ID NO: 10068164 - DNA, 22 bp, Homo sapiens
tccagctcagggttggctcaag

SEQ ID NO: 10068165 - DNA, 22 bp, Homo sapiens
tccagctggggacatgggcttc

SEQ ID NO: 10068166 - DNA, 22 bp, Homo sapiens
tccagctggggcagtggctggg

SEQ ID NO: 10068167 - DNA, 22 bp, Homo sapiens
taggaaaaatacagaattatat

SEQ ID NO: 10068168 - DNA, 22 bp, Homo sapiens
taggaaaagcacaggatgttct

SEQ ID NO: 10068169 - DNA, 22 bp, Homo sapiens
taggaaaagtctagattgatga

SEQ ID NO: 10068170 - DNA, 22 bp, Homo sapiens
gttgaggtgatgccagccctgc

SEQ ID NO: 10068171 - DNA, 22 bp, Homo sapiens
ttcaggaggtgagcaagaaggg

SEQ ID NO: 10068172 - DNA, 22 bp, Homo sapiens
ttcaggagaaagttcagtactt

SEQ ID NO: 10068173 - DNA, 22 bp, Homo sapiens
ttcaggagaattccaagaagta

SEQ ID NO: 10068174 - DNA, 22 bp, Homo sapiens
tttctccaatgtatcagcacac

SEQ ID NO: 10068175 - DNA, 21 bp, Homo sapiens
tttattaacaactgtggacgt

SEQ ID NO: 10068176 - DNA, 22 bp, Homo sapiens
tttaccatcctcttttagaatt

SEQ ID NO: 10068177 - DNA, 22 bp, Homo sapiens
ttttgatatcatgatgaacaga

SEQ ID NO: 10068178 - DNA, 40 bp, Homo sapiens
taatacgactcactataggcccttattagaggattctgct

SEQ ID NO: 10068179 - DNA, 41 bp, Homo sapiens
aattaaccctcactaaaggtttttttttcctgagacagagt

SEQ ID NO: 10068180 - DNA, 42 bp, Homo sapiens
taatacgactcactatagggtgaggtagtaagttgtattgtt

SEQ ID NO: 10068181 - DNA, 41 bp, Homo sapiens
aattaaccctcactaaagggaaagtagtaagttgtatagtt

SEQ ID NO: 10068182 - DNA, 20 bp, Homo sapiens
gaggcaggagaattgcttga

SEQ ID NO: 10068183 - DNA, 39 bp, Homo sapiens
aattaaccctcactaaaggcctgagacagagtcttgctc

SEQ ID NO: 10068184 - DNA, 20 bp, Homo sapiens
attaaccctcactaaaggga

SEQ ID NO: 10068185 - DNA, 20 bp, Homo sapiens
taatacgactcactataggg

SEQ ID NO: 10068186 - DNA, 26 bp, Homo sapiens
  misc_feature (1)..(1): r is a or g
  misc_feature (3)..(3): r is a or g
  misc_feature (5)..(5): r is a or g
rtrgrgcctatagtgagtcgtattat

SEQ ID NO: 10068187 - DNA, 22 bp, Homo sapiens
  misc_feature (17)..(17): r is a or g
  misc_feature (19)..(19): r is a or g
  misc_feature (21)..(21): r is a or g
aaaggaggagctctagrartra

SEQ ID NO: 10068188 - DNA, 25 bp, Homo sapiens
  misc_feature (20)..(20): r is a or g
  misc_feature (22)..(22): r is a or g
  misc_feature (24)..(24): r is a or g
cctaggaggaggacgtctgrcrarg

SEQ ID NO: 10068189 - DNA, 26 bp, Homo sapiens
  misc_feature (1)..(1): r is a or g
  misc_feature (3)..(3): r is a or g
  misc_feature (5)..(5): r is a or g
rcrcrtatagtgagtcgtattatctt

SEQ ID NO: 10068190 - DNA, 22 bp, Homo sapiens
taatacgactcactataggcca

SEQ ID NO: 10068191 - DNA, 34 bp, Homo sapiens
gctagcactagttaatacgactcactataggcca

SEQ ID NO: 10068192 - DNA, 19 bp, Homo sapiens
aaaggaggagctctagata

SEQ ID NO: 10068193 - DNA, 29 bp, Homo sapiens
tgacctgcagaaaggaggagctctagata

SEQ ID NO: 10068194 - DNA, 12 bp, Homo sapiens
aattgcttgaac

SEQ ID NO: 10068195 - DNA, 10 bp, Homo sapiens
actgcactcc

SEQ ID NO: 10068196 - DNA, 10 bp, Homo sapiens
cactgcactc

SEQ ID NO: 10068197 - DNA, 11 bp, Homo sapiens
ctagactgaag

SEQ ID NO: 10068198 - DNA, 11 bp, Homo sapiens
gaagtttgaag

SEQ ID NO: 10068199 - DNA, 10 bp, Homo sapiens
tcactgcaac

SEQ ID NO: 10068200 - DNA, 12 bp, Homo sapiens
tctaagagaaag

SEQ ID NO: 10068201 - DNA, 10 bp, Homo sapiens
gggcagtgga

SEQ ID NO: 10068202 - DNA, 12 bp, Homo sapiens
aattgcttgaac

SEQ ID NO: 10068203 - DNA, 9 bp, Homo sapiens
agcagccca

SEQ ID NO: 10068204 - DNA, 10 bp, Homo sapiens
aggcaagacg

SEQ ID NO: 10068205 - DNA, 11 bp, Homo sapiens
agggaaagaat

SEQ ID NO: 10068206 - DNA, 11 bp, Homo sapiens
agggaaagaat

SEQ ID NO: 10068207 - DNA, 9 bp, Homo sapiens
attcagttg

SEQ ID NO: 10068208 - DNA, 11 bp, Homo sapiens
ctagactgaag

SEQ ID NO: 10068209 - DNA, 11 bp, Homo sapiens
ttcagagtggt

SEQ ID NO: 10068210 - DNA, 11 bp, Homo sapiens
ttcagagtggt

SEQ ID NO: 10068211 - DNA, 9 bp, Homo sapiens
agcagccca

SEQ ID NO: 10068212 - DNA, 11 bp, Homo sapiens
agtttgccttg

SEQ ID NO: 10068213 - DNA, 11 bp, Homo sapiens
atcagagggtg

SEQ ID NO: 10068214 - DNA, 10 bp, Homo sapiens
atggtgggag

SEQ ID NO: 10068215 - DNA, 9 bp, Homo sapiens
cccaggaag

SEQ ID NO: 10068216 - DNA, 10 bp, Homo sapiens
gggcagtgga

SEQ ID NO: 10068217 - DNA, 10 bp, Homo sapiens
gggcagtgga

SEQ ID NO: 10068218 - DNA, 12 bp, Homo sapiens
tcaagctcattc

SEQ ID NO: 10068219 - DNA, 9 bp, Homo sapiens
tggaaagtt

SEQ ID NO: 10068220 - DNA, 9 bp, Homo sapiens
tggagagtt

SEQ ID NO: 10068221 - DNA, 9 bp, Homo sapiens
tggagagtt

SEQ ID NO: 10068222 - DNA, 10 bp, Homo sapiens
tcactgcaac

SEQ ID NO: 10068223 - DNA, 12 bp, Homo sapiens
ccaggaagtgga

SEQ ID NO: 10068224 - DNA, 9 bp, Homo sapiens
agcctgggc

SEQ ID NO: 10068225 - DNA, 14 bp, Homo sapiens
cagcccgagcaaca

SEQ ID NO: 10068226 - DNA, 12 bp, Homo sapiens
ctccttgaggac

SEQ ID NO: 10068227 - DNA, 11 bp, Homo sapiens
cctgttgttca

SEQ ID NO: 10068228 - DNA, 8 bp, Homo sapiens
ctccacca

SEQ ID NO: 10068229 - DNA, 10 bp, Homo sapiens
gaagttcaga

SEQ ID NO: 10068230 - DNA, 7 bp, Homo sapiens
gctggaa

SEQ ID NO: 10068231 - DNA, 12 bp, Homo sapiens
ccaagaagtgga

SEQ ID NO: 10068232 - DNA, 9 bp, Homo sapiens
gggttttgt

SEQ ID NO: 10068233 - DNA, 7 bp, Homo sapiens
gaccaga

SEQ ID NO: 10068234 - DNA, 9 bp, Homo sapiens
taatgtgaa

SEQ ID NO: 10068235 - DNA, 9 bp, Homo sapiens
taatgtgag

SEQ ID NO: 10068236 - DNA, 9 bp, Homo sapiens
cccatgttt

SEQ ID NO: 10068237 - DNA, 10 bp, Homo sapiens
ctccttgagg

SEQ ID NO: 10068238 - DNA, 9 bp, Homo sapiens
taagttctg

SEQ ID NO: 10068239 - DNA, 10 bp, Homo sapiens
taagttctgc

SEQ ID NO: 10068240 - DNA, 9 bp, Homo sapiens
gaaggaagc

SEQ ID NO: 10068241 - DNA, 9 bp, Homo sapiens
taagaaaag

SEQ ID NO: 10068242 - DNA, 8 bp, Homo sapiens
ggtgctaa

SEQ ID NO: 10068243 - DNA, 11 bp, Homo sapiens
agtttgtcagt

SEQ ID NO: 10068244 - DNA, 12 bp, Homo sapiens
tggagcctgggc

SEQ ID NO: 10068245 - DNA, 7 bp, Homo sapiens
ggtccgt

SEQ ID NO: 10068246 - DNA, 7 bp, Homo sapiens
tctagac

SEQ ID NO: 10068247 - DNA, 7 bp, Homo sapiens
cactaaa

SEQ ID NO: 10068248 - DNA, 12 bp, Homo sapiens
ggttgtatggtt

SEQ ID NO: 10068249 - DNA, 10 bp, Homo sapiens
ccatattttg

SEQ ID NO: 10068250 - DNA, 11 bp, Homo sapiens
gtttgtacagt

SEQ ID NO: 10068251 - DNA, 7 bp, Homo sapiens
ctccacc

SEQ ID NO: 10068252 - DNA, 24 bp, Homo sapiens
aattgcttgaacccaggaagtgga

SEQ ID NO: 10068253 - DNA, 22 bp, Homo sapiens
actgcactccagcctgggctac

SEQ ID NO: 10068254 - DNA, 22 bp, Homo sapiens
cactgcactccagcccgagcaa

SEQ ID NO: 10068255 - DNA, 22 bp, Homo sapiens
ctagactgaagctccttgagga

SEQ ID NO: 10068256 - DNA, 22 bp, Homo sapiens
gaagtttgaagcctgttgttca

SEQ ID NO: 10068257 - DNA, 22 bp, Homo sapiens
tcactgcaacctccaccacgtg

SEQ ID NO: 10068258 - DNA, 22 bp, Homo sapiens
tctaagagaaaggaagttcaga

SEQ ID NO: 10068259 - DNA, 22 bp, Homo sapiens
gggcgtggagctggaatgatgt

SEQ ID NO: 10068260 - DNA, 22 bp, Homo sapiens
aatcacttgaacccaagaagtg

SEQ ID NO: 10068261 - DNA, 22 bp, Homo sapiens
agcaagaccagggttttgtgtt

SEQ ID NO: 10068262 - DNA, 21 bp, Homo sapiens
aggcagagaggaccagagact

SEQ ID NO: 10068263 - DNA, 22 bp, Homo sapiens
gggaaataattaatgtgaagtc

SEQ ID NO: 10068264 - DNA, 22 bp, Homo sapiens
aggaaaaaaattaatgtgagtc

SEQ ID NO: 10068265 - DNA, 18 bp, Homo sapiens
tattcatgcccatggtga

SEQ ID NO: 10068266 - DNA, 22 bp, Homo sapiens
ctggactgagctccttgaggcc

SEQ ID NO: 10068267 - DNA, 22 bp, Homo sapiens
ttctgatggttaagttctgtca

SEQ ID NO: 10068268 - DNA, 22 bp, Homo sapiens
ttcaagtgtttaagttctgctt

SEQ ID NO: 10068269 - DNA, 21 bp, Homo sapiens
aggccaagaaggaagcagagg

SEQ ID NO: 10068270 - DNA, 18 bp, Homo sapiens
agtttgtgtaagaaaagc

SEQ ID NO: 10068271 - DNA, 22 bp, Homo sapiens
attaggagagtgggtgctaagt

SEQ ID NO: 10068272 - DNA, 23 bp, Homo sapiens
tggaggagagtttgtcagtatag

SEQ ID NO: 10068273 - DNA, 22 bp, Homo sapiens
cccgggtggagcctgggctgtg

SEQ ID NO: 10068274 - DNA, 22 bp, Homo sapiens
agggcaggaggtccgtcccttc

SEQ ID NO: 10068275 - DNA, 22 bp, Homo sapiens
gtgacagtgaatctagacagac

SEQ ID NO: 10068276 - DNA, 22 bp, Homo sapiens
ctcagctcatccactaaatccc

SEQ ID NO: 10068277 - DNA, 21 bp, Homo sapiens
ggaatggtggttgtatggttg

SEQ ID NO: 10068278 - DNA, 22 bp, Homo sapiens
tgatagatccatattttggtaa

SEQ ID NO: 10068279 - DNA, 22 bp, Homo sapiens
tgggttttgtttgtacagtgta

SEQ ID NO: 10068280 - DNA, 22 bp, Homo sapiens
tcactgcaacctccaccttccg

SEQ ID NO: 10068281 - DNA, 705 bp, Homo sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 10068282 - DNA, 80 bp, Homo sapiens
gtgaggtagtaagttgtattgttgtggggtagggatattaggccccaattagaagataactatacaacttactactttcc

SEQ ID NO: 10068283 - DNA, 22 bp, Homo sapiens
tgaggtagtaagttgtattgtt

SEQ ID NO: 10068284 - DNA, 100 bp, Homo sapiens; identical to SEQ ID NO: 6837399

SEQ ID NO: 10068285 - DNA, 24 bp, Homo sapiens
aattgcttgaacccaggaagtgga

SEQ ID NO: 10068286 - DNA, 87 bp, Homo sapiens
cccgtgaggaacagtggcgggattgtcccagggccccttccagcagggggacctcctgacttgagagtccccaaagccttcccaggg

SEQ ID NO: 10068287 - DNA, 90 bp, Homo sapiens
ctccacctgtttgctagcataacaggcgtgaaggcggcagtgtcgccggcgtccttccgcggaagcccagtgtgtgcagacagcacgggg

SEQ ID NO: 10068288 - DNA, 60 bp, Homo sapiens
tgggttcctggcatgctgatttgtgacttaagattaaaatcacattgccagggattacca

SEQ ID NO: 10068289 - DNA, 126 bp, Homo sapiens
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 10068290 - DNA, 74 bp, Homo sapiens
aggtgcaggagcttagctgattggtgaacagtgattggtttccgctttgttcacagtggctaagttctgcacct

SEQ ID NO: 10068291 - DNA, 88 bp, Homo sapiens
ctctaacaaggtgcaggagcttagctgattggtgaacagtgattggtttccgctttgttcacagtggctaagttctgcacctgaagag

SEQ ID NO: 10068292 - DNA, 81 bp, Homo sapiens
tggggacagttaagttggagccgctggggcagaggccgttgctgacgggccggccgctgctgcacagtcagcttgggtgcg

SEQ ID NO: 10068293 - DNA, 80 bp, Homo sapiens
ggtcaaatgtattgaaagttgcaaaaattcttcttacaaacataaagtgtgctgaatccactacgtaaaccaaaatcaaa

SEQ ID NO: 10068294 - DNA, 82 bp, Homo sapiens
ggctgtgagcggggcggggcggggctttcggaggagctcctgttgttctgggcgcggtgaactctctcttgtatttgcagtc

SEQ ID NO: 10068295 - DNA, 68 bp, Homo sapiens
ctccggtgcctactgagctgatatcagttctcattttacacactggctcagttcagcaggaacaggag

SEQ ID NO: 10068296 - DNA, 86 bp, Homo sapiens
tagcagctattgtgtacgcaaagcctgagtacagcctgctggtgtcatggccacgtgtgagcaggccagcgtcacacggctcgctg

SEQ ID NO: 10068297 - DNA, 66 bp, Homo sapiens; identical to SEQ ID NO: 6836131

SEQ ID NO: 10068298 - DNA, 68 bp, Homo sapiens
tgagccctcagccctcatggctttcccgatgctcaccggtgcagaggagccagctggggagcctctgt

SEQ ID NO: 10068299 - DNA, 109 bp, Homo sapiens; identical to SEQ ID NO: 6777098

SEQ ID NO: 10068300 - DNA, 22 bp, Homo sapiens
gagtcctgtgagtcttcctagc

SEQ ID NO: 10068301 - DNA, 19 bp, Homo sapiens
aaagccatgagggctgagg

SEQ ID NO: 10068302 - DNA, 22 bp, Homo sapiens
ttctcagttctgtgcaggagtg

SEQ ID NO: 10068303 - DNA, 19 bp, Homo sapiens
tgctggagtcctcaagacc

SEQ ID NO: 10068304 - DNA, 19 bp, Homo sapiens
gtgagcatcgggaaagcca

SEQ ID NO: 10068305 - DNA, 22 bp, Homo sapiens
cttctcactctctgggctatac

SEQ ID NO: 10068306 - DNA, 24 bp, Homo sapiens
atcctaggaggaggacgtctgcag

SEQ ID NO: 10068307 - DNA, 28 bp, Homo sapiens
gctctaggataatacgactcactatagg

SEQ ID NO: 10068308 - DNA, 22 bp, Homo sapiens
taatacgactcactataggcca

SEQ ID NO: 10068309 - DNA, 34 bp, Homo sapiens; identical to SEQ ID NO: 10068191
